United States Patent 12,577,609 (METHODS FOR CELL-TYPE SPECIFIC PROFILING TO IDENTIFY DRUG TARGETS) - sequence listing, part 4

SEQ ID NO: 3099 - DNA, 3086 bp, Homo sapiens
  ENST00000527323
gggatccgggaaaggagaggtggccggcacgcctgggaactgggaaatccctttcctggattcactgggagcaccgggaggtggctgagaaccctacttctgtgaggggagcagtgaggcagggaaaccctaggtttggggatggataagcaggggcaggagagcagagcttgcaggcaggagcccaggttctagtcttgggaaggcctgggttctgagcaggcccatctgtccggcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaag

SEQ ID NO: 3100 - DNA, 690 bp, Homo sapiens
  ENST00000526468
agattcctgggtcttttctgcaagctgaggggagttaagtggcaccctggccaaggaaccccagattctccctagcacccgcttccccccccggggcaggttggtagagcaggctaatgtgcatccctcctgccccaggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacc

SEQ ID NO: 3101 - DNA, 879 bp, Homo sapiens
  ENST00000527897
gagtgggtggacgtggtcgtggatgacctgctgcccatcaaggacgggaagctagtgttcgtgcactctgccgaaggcaacgagttctggagcgccctgcttgagaaggcctatgccaagtgagtagcggctgagggggcaactccagcttccagctccccctaggggtgggggctcatgactgtcttctcagagggtcctgcttgatgccagagtgctgacctggagctgcccacagggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtactgccctgggtggggccttccctgaagggcggttcctgccccctggcctgtccttgcctctctggcacctgaccagggctgtggaaggtgctggctcctcctttcccctcctgcagcaccttatctctcttctggggacacccatctgagatgcctatcatgtcctgccctgactgactgtagttcatgtgtgcagctgcctgcctgggctgtgaattccaagaggacaggcttcatctgggtgctgagcagggcttggagaggatgagggtatgggaggcggagtgttaaagtgcgtgcatgggccaggtgcactggctcacacctgtaatcccaacactttgggaggctgaggtgggcagatcacctgaggtcaggagttcga

SEQ ID NO: 3102 - DNA, 878 bp, Homo sapiens
  ENST00000533079
gctctggcaaataggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggaggtaggtgtggcaccatgacccacctgcagtcacacacccctgatggtgccagaggggagcaacccagtggcaaacccaccctggcctggagagctaagaagtcaccttgtttcactgcttgaaaaatgcttctccccacctgttcagtgggcagagcaaacattgctctcctgagggtcagcacaggtagtcagtgagggagctggatttgagccctggtcctcagagcccctgtctgacatgtacacatgaggcttttcctgccttgccatctacaccaagtaagtgccaactagggcggtccagcaatgtcaggagcagggcattagacaggctgagagttctgtacccttg

SEQ ID NO: 3103 - DNA, 348 bp, Homo sapiens
  ENST00000527887
cagactggccctgatgagaccaccccctagaagcggaaccttggcgcttgaccttgaggaggccacctgggctgggccgggggaagacaggccagggtagacaggccccagggacagaggccaggcaggtcagtgcccaccagccctggcagagccctgctcctcacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacac

SEQ ID NO: 3104 - DNA, 572 bp, Homo sapiens
  ENST00000530495
gtttttgaaactgaatcttactctgtcgcccaggctggagtgctgtggcacgatctcagctcactgcaacctccgcctcccagaggtggagtttcaccatattgtccaggctggtctcaaaactcctgacctcaagtgatccgtctgcctgggcctcccaaagcgctgggattacagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctggg

SEQ ID NO: 3105 - DNA, 643 bp, Homo sapiens
  ENST00000525013
ctgcagtgagtagggttgttacattttacagatgaggaaactgaggcaaaatgtcttgttagggtcacacaggctgtgagtgagccatgccccagctctccagccccttggccaggacaaggagcctggagtctgggtctgggggtggcccctgagggtgggctgagtgggcagctgcagccctgctccctcctccctcccaccagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcat

SEQ ID NO: 3106 - DNA, 2828 bp, Homo sapiens
  ENST00000528165
tgggattagcagcgcagcctggccaggcacagtggctcacacctgtagtcccaacactctgggaggccgaggcaggagtcgcttcagcccaggagttcaacaccagcctggacaatatggagagaccctgtctctgcaaaaaagtacaaaaattagctgggcgtggtggcatgcacctatagtcccagctactcaggaggctgagttgggaggatggcttgagaccagggaggttaaggctgcagtgagctgtgatcacatcagtgcactccagcctgggcaacagagcaagaccctgtctcaaaaaaaaaagcaggagcagcaccttagtgccaaagaaaagtctacctttcctcccagagcctcctgggccaggctgagtggcttggggaacaccacgtgactggcttcactccccagggcagacaactgctggcctctcatcccctcccctcccctttgctgccactgacctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatgtatccttccgtttgcttttgtctcctgagtggggttttgggtggaggtatcggtgctgggagaactgtcccaggacagcacagagaacaggacagagccatgcggagtgtggacacacagtgccccatgctcagatgtctccctggacgtcttcctgttggttgggagggagaaactgaggcacagacctgtgtcaagtgaaaggtggagcaagacctgggtccccattgaccctgaggctggtgctatttctgacccctccccagcccactccactgcagcccagctcagagaataaggcaagcccggctgtgggctgactgtacatggcttttgctgcttctcctcacccagccccaagtcgacttgccggctcggcggccatctccccttctgcacagttgcccactctcccatgactggtctaagtgatggaatttccttcttaacggccacccagcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaaggtgggaacctccctgggcccatggttggggaagagttccaggcgatcgaattttcttatctggccagtgttccctgtcctttcctggaaatgagcctgggcctcagagccaaccctgaagcccgggccacctgaatcctgaaaggctggggtgggggtgtctggattctgggaaaggagcaggaggggaggtccaggcccttggaggcccctatgggagcagcactctggtttcccaggggtggaggaggtaagaaagtaacccctccatgaggttcctgaggtggctcctgagacgtggagttgggggctggacctggggtttgggtggggaagaagccagggagccatttctgcggccccagctgacctgcctgttctcccgcagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtg

SEQ ID NO: 3107 - DNA, 643 bp, Homo sapiens
  ENST00000533704
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccg

SEQ ID NO: 3108 - DNA, 1415 bp, Homo sapiens
  ENST00000530567
taaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctggtaggttgtccccactcacctcagtcatgcaggtgcgggccgggcaggtgggaagggccgggtgactcagcctggccctcaccctctgccgccacctcagtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 3109 - DNA, 2669 bp, Homo sapiens
  ENST00000357568
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctga

SEQ ID NO: 3110 - DNA, 2955 bp, Homo sapiens
  ENST00000349748
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 3111 - DNA, 3228 bp, Homo sapiens
  ENST00000397163
ttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 3112 - DNA, 2358 bp, Homo sapiens
  ENST00000638141
agaggattaggcgtggactgagggtgcagtgggaaagaggcagcagggaaggcccagctctactcccagagcattcgccatgccctacctgctgtcaggattcttctgtgactgtgtgatccaagagagggacaggagaaatggagagggcaccatcgcacagcccctcaagtttgaggggcaggattttgtcgttctcaaagatgtctggcccagaagtgcctctttgaagattgtgtgttcctagcaggtgttcaggccctggcctcccatgagctgagccacaaaaccaagatttaggccatcacatggaaaaggccaaaggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttacccc

SEQ ID NO: 3113 - DNA, 1643 bp, Homo sapiens
  ENST00000397200
ccctcctccacgcttacagccacacacacagtcacacagacgcgttctgagggtggctgcccgcttgggatggaggaatcacttccctcagaacccagccaagtcctctaggcctccttgggggtccttccagcctgaggggcttcggagctgaggagcagctgttctgatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 3114 - DNA, 908 bp, Homo sapiens
  ENST00000569827
cagtcacacagacgcgttctgagggtggctgcccgcttgggatggaggaatcacttccctcagaacccagccaagtcctctaggcctccttgggggtccttccagcctgaggggcttcggagctgaggagcagctgttctgatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttct

SEQ ID NO: 3115 - DNA, 563 bp, Homo sapiens
  ENST00000567071
cgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagttttcctttgtgcctccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactgg

SEQ ID NO: 3116 - DNA, 1271 bp, Homo sapiens
  ENST00000337571
cataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctgg

SEQ ID NO: 3117 - DNA, 1029 bp, Homo sapiens
  ENST00000569136
ataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatc

SEQ ID NO: 3118 - DNA, 915 bp, Homo sapiens
  ENST00000561817
cagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 3119 - DNA, 555 bp, Homo sapiens
  ENST00000565173
tgaccacaggcgattggttttagtggtaggtgtgtggggatctgttctggtcatctggatgctggtcatcggtgtgcagtattgatcaggacctgcaaacccaaaagcttatgggagctggcacgtcaccccatcatcttcgtttcggacagagcaaacagcaacaaggagctgggtgtggaccaggagtcagaggagggcaaaggcaaaacaagccctgataagcaaaagcagtccccacaggtgtctgggcatgtggcatgggtggggtggccagcacgctacaggggcttcctatgcgcttgggatacacaggggctggaggcttcccaggagtttgtcttgaacatctggaggtttgaatttgtcccactgaccttttctttcagcaagttcccctgaaatttgggctgctgcttgggtgaatatcccaggatgggggttccattctaggagtggactggcaggctgagcctcccatggagctgatccagccaggatacagagaaggggaggcaaaggctgagacagaaccagcttgagagcggaggcgca

SEQ ID NO: 3120 - DNA, 1237 bp, Homo sapiens
  ENST00000397204
cacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctgg

SEQ ID NO: 3121 - DNA, 711 bp, Homo sapiens
  ENST00000565559
tctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacaggtgtctgggcatgtggcatgggtggggtggccagcacgctacaggggcttcctatgcgcttgggatacacaggggctggaggcttcccaggagtttgtcttgaacatctggagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatga

SEQ ID NO: 3122 - DNA, 734 bp, Homo sapiens
  ENST00000565274
aaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatccctgacctccctcctccagacagatggctctggaaagctcaacctgcaggagttccaccacctctggaacaagattaaggcctggcagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggaccca

SEQ ID NO: 3123 - DNA, 593 bp, Homo sapiens
  ENST00000564503
agtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaag

SEQ ID NO: 3124 - DNA, 1934 bp, Homo sapiens
  ENST00000466222
ttcagcaagttcccctgaaatttgggctgctgcttgggtgaatatcccaggatgggggttccattctaggagtggactggcaggctgagcctcccatggagctgatccagccaggatacagagaaggggaggcaaaggctgagacagaaccagcttgagagcggaggcgcaactcttgtctcctggtggccttgagcatttcacaatagggggataaaggataggagcagaaaagtggggctgacttcagaaatggggtcctctagagctcacgggagggtgttagattggagtgggagcttagtggaggtgagccttagaggcaaaagtctccagaccaatccagggcccctcttctatccgggggcccctcttctatccagggcccctcttctgtctgggagcccctcttctatctggggcctcatgcagtggggcctaggggaggttctctgaggacttggccttgatgacagggtggctggaggaatcagaacggtcagaccttctttgacctgcgggcacctttagttggaatggtcaggcctgggatggtggagggggctcttgcaggtggggactggggtggcggggaggaggctgtatggccgccatatctcctttggctgggggcgtcagggctggagaggtgtgaagagtccctgaggcctcgatgcatctcactccagctcaccaggtctgcatttgcccgtccccagctcctgctgccacctccggccgttttaggcacttggctcccttggcccagaggagcttgcctcacaggcctgtgcacctctgacccctgtgaaccagttttcctttgtgcctccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtcc

SEQ ID NO: 3125 - DNA, 385 bp, Homo sapiens
  ENST00000562199
gacatggagatctgtgcagatgagctcaagaaggtccttaacacagtcgtgaacaaacacaaggacctgaagacacacgggttcacactggagtcctgccgtagcatgattgcgctcatggatatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcag

SEQ ID NO: 3126 - DNA, 711 bp, Homo sapiens
  ENST00000567817
aaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgta

SEQ ID NO: 3127 - DNA, 598 bp, Homo sapiens
  ENST00000568153
gattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggc

SEQ ID NO: 3128 - DNA, 1291 bp, Homo sapiens
  ENST00000356316
cataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacgtgagtagacctccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 3129 - DNA, 3172 bp, Homo sapiens
  ENST00000318023
cactctctttctctctccctctggcatgcatgctgctggtaggagacccccaagtcaacattgcttcagaaatcctttagcactcatttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 3130 - DNA, 534 bp, Homo sapiens
  ENST00000531028
gaacccggggaatgcgagcgccagcccccgccgcaggccagtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgca

SEQ ID NO: 3131 - DNA, 4397 bp, Homo sapiens
  ENST00000278559
gaatgcgagcgccagcccccgccgcaggccagtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccggggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaa

SEQ ID NO: 3132 - DNA, 597 bp, Homo sapiens
  ENST00000527066
agtcccagctggatctccggccagagcccgaggctgctgcgccgggcggctgcagcctccgctccagcgcccgcgccgtgccctgcatcccgggagcccggctggacccgcggcggctcggccggttgtctctccggtggggagtgagcgagcacacagcccccaccccaccccgggtgagagagaatgtcctgcacagggacgcccagctgtatctacctgctgtcagcactttctctgcaggacctggtgctggactgggagccccgaggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtgg

SEQ ID NO: 3133 - DNA, 2333 bp, Homo sapiens
  ENST00000529629
agctggatctccggccagagcccgaggctgctgcgccgggcggctgcagcctccgctccagcgcccgcgccgtgccctgcatcccgggagcccggctggacccgcggcggctcggccgatgagaattctgaagcacaaagaggttaactgctttgcacctcgctggcctcagtctccccatctgaggacgggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcatt

SEQ ID NO: 3134 - DNA, 2805 bp, Homo sapiens
  ENST00000456580
agagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagtacagtggccattcgctggcccctcacaggcctggctggggagatgcacggagaatggagaatgtccccaggcctgggagctcagggtgtccgtcctcctcgctcagggcccgggacctgggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccgg

SEQ ID NO: 3135 - DNA, 542 bp, Homo sapiens
  ENST00000533889
ttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaagtaggtgccagcagcaggcaggtgggtgggaggcccagacgggggtggcaccggatgggctcctcgtggtattccgttagccagggctttaggcacagagaagtgaggggctgg

SEQ ID NO: 3136 - DNA, 2564 bp, Homo sapiens
  ENST00000527129
gtttggtggatgaggaaggggaagattactggtggttggggccgggccctgggaggctctgggcatctactgggcccccactgctcctccctcaggcctcagggccccttgcagccccttagccttcctgcattggaggccttgctgggcaccaggaggaggcatccttgagcatagccaggtggggtcacctatggccgcaccgcctggcctggaacctgaggccttccacgtgttgtgatgcccagtgtgtggtgacagtcagcatggcgggaccccatgtgcctgtcagaccttgagaacggaatgaagccaccgggccctgcagaggctgggtacatgctgagtccttggcatctgatgtgcctggccacgccgtggcactttgtttatactcttgtgctggtacattcattgcatgctagtgtcttgtgacatattgttgtgactttgccatgtgacgatcttcactagtgtgaccagaacacttttttcaggattgtcaggcaggtcctggcagctggtgatggcatttcgtggacaggtgctgtgacctctgcagatcctgatacttggttgtgctgttggagtcagaaaccccactgacattgttaccagggggattcctattgccctctattttttttgtttgtttgttttacagagggtcttgctctgtaacccagaccagagggcagtggtgctgtcatagctcattacagtctcaaactcctggactcaaacgatcctcccacctcagtctccctagtagttgggactataggtgaacaccaccatgcctggctaatttttaagttttttgtagagctggggtctcgctttgttgcccatgctgaccttgaacgtccagcttcaagtgttcctcccaccttggcctcccaaagcgctgggattacaggcatgagccactgcgcccagcctcctttaatagtttttattgagatataattcacagagcatgcaattcagccatgtaaagtatacaatctaatgacttttgtgtgatcagagtttatgcaaccatcaccacaatcaactgtagaacattttcatctccccaaaagaaacccactccctttaaccaccaccacccattcccattgacctcttcccttcagccctgggcaaacacgaatccgcttctgttattatagatttgcctgttccggacatttcatataaagggattccatcgtcccttccatggtggtgagggggaggcggggtgggccagggtgttgtagggtgtgtctccgcgtggcccagcccctcccgcctcctgcaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccgg

SEQ ID NO: 3137 - DNA, 2362 bp, Homo sapiens
  ENST00000271971
actcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggaaatcgtgaaaaacccagaattcattcttggaggggccaccaggactgatatctgccagggagagctgggagactgctggctattagccgccatcgcctcccttacgcttaatcaaaaagcactggccagagtcatcccccaggaccaaagctttggccctggttatgccgggatattccatttccagttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacagttctccggagtggcgttctgttggtccagctgagcagaagcgtctgtgtcacactgctctggatgatggggaattctggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctga

SEQ ID NO: 3138 - DNA, 2484 bp, Homo sapiens
  ENST00000354537
tcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggaaatcgtgaaaaacccagaattcattcttggaggggccaccaggactgatatctgccagggagagctgggagactgctggctattagccgccatcgcctcccttacgcttaatcaaaaagcactggccagagtcatcccccaggaccaaagctttggccctggttatgccgggatattccatttccagttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacaggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctgattttgtgctactcctttgtaaagtcactgccttaagggggctgatggcgccacctgtgccttacatccaggttcaggcatcactagctttcccacactctactttccttatttccttccattaagaattactcagagttctaacgcacagaatcctgacttccatgtagctccagtcattgtgatcagacatcctttataaaacatgtttttataaatgtgtatgtggaat

SEQ ID NO: 3139 - DNA, 510 bp, Homo sapiens
  ENST00000480004
attcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagcta

SEQ ID NO: 3140 - DNA, 2173 bp, Homo sapiens
  ENST00000366666
actcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccagggttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacagttctccggagtggcgttctgttggtccagctgagcagaagcgtctgtgtcacactgctctggatgatggggaattctggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctga

SEQ ID NO: 3141 - DNA, 2068 bp, Homo sapiens
  ENST00000264203
gtggaagcgccgggccctgctgcgggggggagagccactgacgccgggaccgggaccgccgccgccgccgccaccatgctccatgcctgaccgtgactcgcatctcgccaggccagtgcatttcctcttctggctgtcatcggaattttcaagtgtcaagaccccactttgttcctgttgtcctggttccggctttgggaagcatgacctttcaggcctgctcagagacaccgcagtgcactttgtgcgttatcagccttacagagactctacggtcaggagtttttgtggcaatggaactgctggggtttcatctgcaaatgaaaaccatctggccagctgcttgggtcagatggaaaccagatgggagaagtcaggagcgggcagcgagcagcctggggcagcgtccctagtcacgtcatgtttccacttcctcttgccccctcgcctcccctgcctgcaaaacgattgttattaacccatcacctcctccaatgcccaggcagttccaggatacagggttctctcgcccaggccttggccagcccagaagatgtgacccagaacctagaaagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagtt

SEQ ID NO: 3142 - DNA, 1568 bp, Homo sapiens
  ENST00000375144
gagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgca

SEQ ID NO: 3143 - DNA, 1686 bp, Homo sapiens
  ENST00000375142
ggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaagccgatccaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatactta

SEQ ID NO: 3144 - DNA, 1462 bp, Homo sapiens
  ENST00000433834
tccctgtacctggggcgcgccttctttgcagcctttggggagcgaggggagctctccatcagggatggggtggtcccggtgctgtgccttctcagttgccgcttctagggaggccgcctaggagccagcgagggaagggcgggcatcggtgtgcccagaaggcagcgcgctgctctgcgggcccttctcgaggctgccgccgtgggtgctgtgcgtgcgaagcattctgcagggcaggccggggtccacggcgcccgggcctgagtgggagccgaggggcgaggatgggtggcccacaggacaaggatgaacgcacaatcgcccttgtgaggccgtggccttggggggccaccaggccctggatccagcatatggcctggacacgatgcacccaagcaggcgcagcctccccttccctctgaactgtcagcttgcaagggttggaactgctgattatggaagtccctcggatcagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccc

SEQ ID NO: 3145 - DNA, 858 bp, Homo sapiens
  ENST00000264202
actgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaa

SEQ ID NO: 3146 - DNA, 579 bp, Homo sapiens
  ENST00000459967
atgttcactcctgggcacccggggaagtggaagcgccgggccctgctgcgggggggagagccactgacgccgggaccgggaccgccgccgccgccgccaccatggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcg

SEQ ID NO: 3147 - DNA, 432 bp, Homo sapiens
  ENST00000457768
gttggtgtcagacacatgtggaaaagaaaagaacaggcccataattttgtctcagtgcccagggccagatgttaaaggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggatt

SEQ ID NO: 3148 - DNA, 488 bp, Homo sapiens
  ENST00000489607
cacccaggttacaacaaagggcaaaagtaatccgctactggagtgtgttcaccatggaaccaactggggggcacgacatctgcagccaccagggcctgttgagcaggagcaggggagccgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatct

SEQ ID NO: 3149 - DNA, 660 bp, Homo sapiens
  ENST00000482808
gggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtgcttctgaattgttggatcctgatgaatcgcaatcaggactatgtttggcttgagctccagcctcatgaccaccaaccccatcgaatgactgagagctgccaggctcctgccacgttggagctcagaatcctcccgtggggacactgtgctgcagccagcctccagggagccgcttgttttatggcctaaaaagtctctttatgctgagaaggtcacactggactttgctcacacagagatttgacccaagaaaaggaataaagaggccttggataccc

SEQ ID NO: 3150 - DNA, 6413 bp, Homo sapiens
  ENST00000178638
ggaccagtgacagaccaagggcatgccactgaaggaatccctagacgcacccttctggatgtgagacaggcggatctcacccacgcctgccagcagctcctcggagaactgtgttcctgggtcagccctggcccagaggagcgccggggacccgcagagtgctgctgaagtcaaggctacaactcacctaggatctggggcgccagccctccggtgggcagggcgttctcctcccccaccccctccccgcacgatgacatcaagtgtttggcgttgagttgctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaggctgttctttttttttttttggaggcgaggttaaagcattactatttgcaaagcactctgtagctccctgttatggggataggtaactaatcagaataataatgtcactcgcatccacttcttagaacctggctccaaaggaaaataagctgatagactcaatcactttcctgaggatggaggcctatggcatgtgtggctgcaggtcgcgaagctgcttaatggtgctgggaagcctagaggaattaaataaagaccctggaggaggtgggatcggagctgcaccttgaacaaatagctcagatttgaacagatggatggaaaagagggaggtgttcccaaccaaggggacatgatacagggaacaggtcctatgtctctttactcctgagagtattaaacctagtaggtgggcagcccctcttggttgcctgttaccttattttgaattctttttgcaaaacatactatcacccgtccaaataatcttttgtctaaatccagacttcacattctgactggggcaaaaagaggcagtccagtaaaggttataaaataggtaccatcattgtttgccttatttagaaaagcatccaattttcactataatcaccctaagcctgagagaggtgaactgttcaagggtactttggctccagtgggtgacagtacctggcccagctttggaattgaaacatttctgatggtctgtactctgctagaacacaggatgcttctgctctccctgctctggcatcctgccaggtgtcatggccacgcacaggcatgaagacagccgggaagccagagttcccacgaagcactcactccttggacttgctcccaccccactggggagagcactcctggagcaggaaatgagcatctctcatctccctgaattccacatccactggctgaatgatcagggaggcatagcagtgagagccataggtcggcagagggaactcaggccctcctttaggatggccatcacctcatctcaatccagccaaatcaaccatctagagcacacaggccgagagaaatgtaataaaatataacatgagacacgtatgaaatttaaactttccggtagccacactagaaaaaggtaaaaaaaaaaaaaccagtgacattaatttaaatttaattttagataatccaacagatctaaaatactatcatttccacatgtaaccagtattttcatgtgtttttttctgcagtaaatctttgaaatctggtgtgtgttttacactgacagcacactcgattcagatgctagattttccttgtagatatttggtcgttatttagatttcataaaatttacagtttaaaagattccaatatccgagttgctccaaacacacttagaagttgttttccaaataatggaatcaatgatcggcttttagatgtaaacttattaaaataaagtagcgtttctcagttaagtcacattccaagcgctcaagatccatgccctgcgcagacccggacgacgaacccgactttcagagactgagggttctgcctagagagctcccacagaaatcagcccgagaagaaagccttgtgggtgaagccagggagggagacaggagggcaggaggaaaatcaagcctaaatgagcacatcgtggacgccgctcttcctctccccacatctcctcgcctcgccgcagtgggcccggctgtgccccaggtccccgcggtcgggagtgaatggcgctcgggtggcaggcacgtgggcacctggtgaactgcaggaccctggcaccgccaccccctcgcccctacacacacaggagtgcccctcccgttgtcacgtggccttcctgctgggtatctggagcagttgcagcctcgcttccggaaggaaacggggcctctggggcacagggaccacctgccagtgcgttccagccgggctgccatccacactggagaccgccccgcacgtggtcctcgggctcggattcagctgtcgcaggatgtgaggggaaaggtatgtggcccgacaatgccaccgagggtgtccccgggctccaccccgtgcctcttcattatagaatgactgggcagagataagggccagattactttgctgtattgaataattcaccataaaaatgattgcaaccagg

SEQ ID NO: 3151 - DNA, 2744 bp, Homo sapiens
  ENST00000344366
gtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaa

SEQ ID NO: 3152 - DNA, 2556 bp, Homo sapiens
  ENST00000422263
gaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttgtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctc

SEQ ID NO: 3153 - DNA, 580 bp, Homo sapiens
  ENST00000560666
agtccagcaagatgccggtggaagacgcagctcctgggcctgccagaacaggtagcaaggcccttgtggcaagcagctcaccgaccttctccgggtgtctgtaccttcctgggcaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgg

SEQ ID NO: 3154 - DNA, 561 bp, Homo sapiens
  ENST00000558287
agacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcaggtaactgtcgtgccagactcagccagagtccacgcggcacctcagtccccatcatcctccatatcacaatcaatgacttgatttcctcatttagtttcattggcagctcttcaaaacctctccaaatatcacaggtgtctgaaagcaccgcagaaattccaggctgagcttcaaaagaagtcaagctaggcaaatgaatagatgtctcctagttcttttttaaaaaaaagagctctaaatctgcatttgctaatatatcctcagtg

SEQ ID NO: 3155 - DNA, 538 bp, Homo sapiens
  ENST00000560293
gacttttagccctgagctttccagagtgtgatgctgaggcctcatctgaggatgagaactccaacaacagggaaaaccttgattagcgagccctgggagggtagcagaagatgtagggtataaggctatgatttgaatgtgagcaggtacaatgcaaactgctggcaaggcagcagtgctcaggcagcagatgtgtttctagtggcctccaggatcactggagtggcctgtgcctcctcaggggaaaagtaagggtgaactcctctgttatttgtggaattttacatcctgggcctccaactgttctgcctgctaagaggttccaagtggacttattttggtaagtagagattttaaatacttttttgttgaaaagaaaatagaaatggttgtatttaatgagaaaaacagaaacttcatgctctgtggaggtgattttgaagggtcggaagcacagttcttgtattgtagaaagagagtacaaaggcatctcctaagaacacttcaacttgggttgcatactgcactttctccaagc

SEQ ID NO: 3156 - DNA, 2403 bp, Homo sapiens
  ENST00000369111
ttatccagcaaacaacgctccctccccgcactccccccaccccaggccacacaggcacgtggacccaggcctcaccgtgggaagggggtggtggcaggcacagaagagattgctccagatgagttctccttgcctcacttctcttccttagaacttaggacacaactcaggttttagttattgacttcctccacccctcccctgcaccctgagtccctaattccttcttgttatatatctcctaattctggactcttcccattccagggcagctcagattatgcagggaattgggaacaggtacccccaccatctgccgcataccacccagggagctgctcctcagaggagaaatcaggcggggggatgaaaatacagtgtccttttgagggggctgagttgaaccccaaagccccttccttgaccctgcctgctccagggaacacccatctaaacagcatctgtgtgactagcagaggaaggaagagctcaccccagctgggctcctgagccagggccagggctccagtgaaacttgccgcgctccagctccgagtggggccatcctgcatgcctaattggctatttaaggagctgttcaccagcagcccaggcagcacccccgtccccacatacaccagttcagagccaccttaaaagcaggaggcagttgtaaagtcgctggccagctagtggagtggagactgcagagggagataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagcccttcagcctctcaatcagcgcatggtctttgcttctttcatccaagcaggatcctcgtataccacaggtgaaatgctgagtctaggtgtaggaatcttggttggctgtctctgccttctcctggctgtttatttcattgctagaaagattcggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgttaatgcagagaacaaactctgtttagttgcaggggaagtttgggatataccccaaagtcctctaccccctcacttttatggccctttccctagatatactgcgggatctctccttaggataaagagttgctgttgaagttgtatatttttgatcaatatatttggaaattaaagtttctgactttaa

SEQ ID NO: 3157 - DNA, 1514 bp, Homo sapiens
  ENST00000582010
gtggagtggagactgcagagggagataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggtgagcagatctcaaggcctcccgacaaccctttcacactgggacctcctcacctggcaggaagacacactgtgcgggtgggaggagacttcctttaccttctcaccctagctcctcccttctggatctcctcctgccttgagtttcacatatatggctcctagatcctgctctaatcatcaaatcctacacctcctgatttggcagaaaagctagttaagtcctcagtaaatcgtgtaggagtgagggagctggggtggaaaggaagctgggtgggaactctgagcttagctgccaggtctccttctggctccgtctatcctaatccatcctacccctaacctgcatctgaaattgggacagagctggaggtcaggggtgaggaagaggctggcaggatagtttctgaccctgggggaggtggaactcagttcctatgaactactgattaatgacttaaccaaactcaagttcatgataaacggtcagtgtgagagcaagaagtgaatgatgagaagtcaggatatctgaatcccaaggccacttgataggggcctccaggagaccgtatctctctaggttatttttttttttttttttttttttgacacagagtcttgctctgtcacccaggctggagtgcagtggcgcaatctgggctcactgcaaactccacctcctgggtttaagtgattctcctgcctcagcttctcgagtagctgggattacaggtgcccaccaccacgtctggctaatttttgcatttttagtagagatggggtttcaccatgttggccaggctggtctcgaactcctgacctcaagcgatccacctgcctcggcctcccaaagtgctgggattacaggcatgagccactgtgcctggcctatctaggatcattttatttctcccatttttctactcctactctctaatcccatctctcagggtattcaggttttctatgcatcccctctgccctcattcagctttcttgtcctcaaaatacaggtaagtaaaagagctaccactccccattcatcaggatagttggggaatcatcactgcctctgggtagggaaggggaactgcagcatgagactcaacaggactcctacctcacccatccctatacaactggggtcttaacctgggtgga

SEQ ID NO: 3158 - DNA, 1382 bp, Homo sapiens
  ENST00000607652
ataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggtgagcagatctcaaggcctcccgacaaccctttcacactgggacctcctcacctggcaggaagacacactgtgcggccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaaggtgagccttaaaaatctatagcaggaagtaagattagactttcaaaaactatccttaaaagccttgggatgaagcaattacatagagccaaggaattttgcttctgggagccctatctaggtaagctagggcacactgaaaggaagatgagtcccagtctgttctccccagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacaggtaagtggtggagaaacgaggtgaggtgagacacagttgtaacttcagaccccttcccactccccaaagtaacacctctcccacgcttctgctcctcagctggaaaagcttcaggggacattgttctccacagaagaggagccctctaagcttctggtacagaactaccgagcccttcagcctctcaatcagcgcatggtctttgcttctttcatccaagcaggatcctcgtataccacaggtgaaatgctgagtctaggtgtaggaatcttggttggc

SEQ ID NO: 3159 - DNA, 938 bp, Homo sapiens
  ENST00000483993
aattcccagtcccctgcaccccttcctgggacactatgttgttctccgccctcctgctggaggtgatttggatcctggctgcagatgggggtcaacactggacgtatgaggctcctcccttctggatctcctcctgccttgagtttcacatatatggctcctagatcctgctctaatcatcaaatcctacacctcctgatttggcagaaaagctaggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagccctt

SEQ ID NO: 3160 - DNA, 594 bp, Homo sapiens
  ENST00000607082
cagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagcccttcagcctctcaatcagcgcatggtctttgcttctttcatccaaggatcctcgtataccacaggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgt

SEQ ID NO: 3161 - DNA, 1717 bp, Homo sapiens
  ENST00000285379
cccggcccgccccgccccgagcgcggggagttcacctccgcccgtcaccacctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 3162 - DNA, 875 bp, Homo sapiens
  ENST00000520127
gggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagcttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttg

SEQ ID NO: 3163 - DNA, 684 bp, Homo sapiens
  ENST00000520996
ggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttagttgatgacccaattcttttttttccctatttttaataaagaatgaccagacagagtatttgtaacatacaggacattctacaaaagagcttaggaaatgcctttgtccctgaaatgttttcaagtttatctcctcctttcatatctgctagttgca

SEQ ID NO: 3164 - DNA, 587 bp, Homo sapiens
  ENST00000518231
agtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaagtaagatatacttttttttttctttccagggaaaaatgtttataagttgatatttagcattaatttcaaaagcttaatttgtaaattcaactcacgcccagtgaaccacttcttttacaaaggaccttcacatttgctttttataacctttaattgtgacatcat

SEQ ID NO: 3165 - DNA, 691 bp, Homo sapiens
  ENST00000522742
gcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagaaaaaggaatcagtatgctcagaaagaaagatgtgaaaaacatccattctccagacaacgcatgtgaggaataaaaacagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgt

SEQ ID NO: 3166 - DNA, 1154 bp, Homo sapiens
  ENST00000300900
ggctccgctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcagtgatgatgttgctggagaacaaggccagcatttctggaggaggactgcctgccccataccaggccaaacagttgcacctgcactggtccgacttgccatataagggctcggagcacagcctcgatggggagcactttgccatggagatgcacatagtacatgagaaagagaaggggacatcgaggaatgtgaaagaggcccaggaccctgaagacgaaattgcggtgctggcctttctggtggaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatttttg

SEQ ID NO: 3167 - DNA, 598 bp, Homo sapiens
  ENST00000585705
gctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcaggtgggctggatggaggccccaggcaggcctgggcacccgagttccccaaggactgagaggatggggctcctcccaggagggtgtgccagacccaggcccatctgtgctgtgaggtggctgaaaatcccatgggggaggacagcttccaggaggagagagcactctagtatgttttcgttacttttgtcagaccagtctgggatgtgggggcaggaaacgttccaggaagaaggacat

SEQ ID NO: 3168 - DNA, 565 bp, Homo sapiens
  ENST00000591725
gctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcagggttggacattggaaacctactaagcagctagaaagtagaaagagaaatgctttgcagttctggtgctttgtagctgtgtggtcttggagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcagtgatgatgttgctggagaacaaggccagcatttctggaggaggactgcctgccccataccaggccaaacagttgcacctgcactggtccgacttgccatataagggctcggagcac

SEQ ID NO: 3169 - DNA, 941 bp, Homo sapiens
  ENST00000586876
gctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagctgctaaggtccctgggccatcagaagcgaatagaacaaacctaagacatcactctccatcaagaggcctgcatgactctttatttacatcatcttccaggaagaggaggaggagctgctttggggacacccacttcctctccttacgtaacaacacactgcatttgcacaagtgtccttggttgtaaagggttccacactcactttcttattcagggcttattacaagcctctcaggtagctatggtcatggtaccctgatcccttgtcaaagatgagcccactgaggctcagggtgactaccgttgtgccaggagttgctaagtggtggatcacagactccagttca

SEQ ID NO: 3170 - DNA, 677 bp, Homo sapiens
  ENST00000590203
gtgaaagaggcccaggaccctgaagacgaaattgcggtgctggcctttctggtggagatcgggagaatgaactggccaccaccactggctccctgcagactttctcaagacccttccctccctttccaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatttttggagaaa

SEQ ID NO: 3171 - DNA, 702 bp, Homo sapiens
  ENST00000587265
gtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacaggtgcacagggcctggggcagggcatgggctcccactgcctggctccccagaaattatccctctgtctgccctcagaggtccctcaggatacaggtggggagcccaggtaactgaagtccgttgttaatcatcgacattcactgaagacaggcaagaaaagcctgagctgttccatcaccagattgggggctagacaggaggcaggggaaggtggagtcattcagaaaatggtgctggggtttctatcatgaacgaggctctggggagacagcagtgagcccaaaggacccaaatccctacccttgcactgctttcattccaaaacagtggttctcaaagtgcggcccctggaccagtggagtcaacatcatcactgggggaatttgttagaaatgctaatcctcagagctactgaatcaggaactctgggggtggagcccaggcatctggggcccaacaagcccgccccccagctgatgctaacgcatgctcaagtttgagagccacagtcctgtagt

SEQ ID NO: 3172 - DNA, 3812 bp, Homo sapiens
  ENST00000317995
cgctcgctccccaggccacagccgctccctcgctctgctggggcctccggacgcgcttcccacgcgggtctctggaacactcggtccgaacgcacgcctgcttgcactcacactgcggttcacacccggaggcgctctcgcactcacactgccgctcacgcgtgctcacactcccccacgcgcgctccgctccggctccagccccgcgcccagcgaaggcgcaggcactgctgccgagagcgccgaggggccccgcggccttcccatggcggacctgagcttcatcgaagataccgtcgccttccccgagaaggaagaggatgaggaggaagaagaggagggtgtggagtggggctacgaggaaggtgttgagtggggtctggtgtttcctgatgctaatggggaataccagtctcctattaacctaaactcaagagaggctaggtatgacccctcgctgttggatgtccgcctctccccaaattatgtggtgtgccgagactgtgaagtcaccaatgatggacataccattcaggttatcctgaagtcaaaatcagttctttcgggaggaccattgcctcaagggcatgaatttgaactgtacgaagtgagatttcactggggaagagaaaaccagcgtggttctgagcacacggttaatttcaaagcttttcccatggagctccatctgatccactggaactccactctgtttggcagcattgatgaggctgtggggaagccgcacggaatcgccatcattgctctgtttgttcagataggaaaggaacatgttggcttgaaggctgtgactgaaatcctccaagatattcagtataaggggaagtccaaaacaataccttgctttaatcctaacactttattaccagaccctctgctgcgggattactgggtgtatgaaggctctctcaccatcccaccttgcagtgaaggtgtcacctggatattattccgataccctttaactatatcccagctacagatagaagaatttcgaaggctgaggacacatgttaagggggcagaacttgtggaaggctgtgatgggattttgggagacaactttcggcccactcagcctcttagtgacagagtcattagagctgcatttcagtagccaaagaggacaggaacaagtctgtcttcatgagggaggaagacaatggtcctataatgcccttggataagaaaaggaaacttttgagctgcaccttcagtttatcctcaaagcctgcgttgtttgtcttcatctaatccagctttgatggacatctgtgatggttgcctgtacacttgctgaaatgaaatattagaaatggctgtatattccaaagaaaccctatattatatatccacattactgctgctaggattcatagttgcacatactgtttattgcttatgtgtagaaggaatgaaactagtttccagagttgttattaatatgaatatatatcatgtgttaatattgagaaaggaaaaatacattcccggtgttagtagttcttcatttcctgtctccaacagaaaattcactcattttagaactagtgtaattcttgataataaaataagagttttgattaagaacagcatagagcttcaaaatgcaaagtgaatgattagtaaaattatgtctcattttattttttcagcacccataccacaattaatattaggctggattgccatgggaaacattttttggcattaatgcagcaacataatactcactttaggtattactacatagttgaaggatttaactgaatgtatggatcaaatttatttatttgacatattcgaagctgtggtttaataggaatttgagaaaggtgtaagaaataggataaaaagaaggtcagcaccatgtaccaggaatagctttactttccatacatagaaatataaatttagtggtatcctatattactttagtgtcgtacgctttgtaagacttaaatattttattctattgattccactactttggtatgttaagacatttctttaaagatgaccaacaatatccttattttaggtgccactagcagatgtaagcgtatacttagttgccgttagatgtgacagaatgagataatttatgtaaagcagtagagtacctggcacaaagcaaacaataaatattattgttattgttgttataattgtaaaatgaatgacttcaaaaacatagtcccagtttggagggattttgtgatgcagaatatctaagtcatagaaatagaagacaggtggaataagtatatgttcagagtttttagatgtgttgagtagagacggtaataatggaagcattaaatacaaatgaaaatcacaccagatatccctgaaattcaagcaaagaaagttcatcatgtattcttgggcagcaagagaaaggactagggttatggcaatgtgtggaaaagttgaggcttgctaagggttgagatctgttggtagccctggatcacatggggtcagcaccaggcagtgcctctgaaagcggagagaggtcctggacttcccttgtgtataacagttcctagtgtccaacaatgaggaaacggtgaagcatggttacaaaactgtgacaaaaatatttacatctagcactgttaccactcacatgccaaacattggctgcacacgtgcagccttatttgtaattaacatcaaaagactagatctgaagccttccataaatgagaggccattcatatggcattcctggaacaaaacactgcacaggtaccagcctctccactcctgaccgggttggtgctgaacagtcagggattgttcttgaactagacttctgatgcttcttgcaatcttctttcatctttccctgaaatacacaaaataaacaaatacaataacaaatagtaattaaatgactttcaggataacatctagttgttcagacttcacccttcacaggtgtgtgtgtatgtgtgtttatgtctgtatattgaagcaatttgaatttatttactgtatattttctgagtaaaagactgaaatgaactacttggttcagatcatggtgtccattggtgacattgtttggaggcataatattctttatatggaaaatcctttaattccacagttagttacctcagattcagaatatgaatactgtttataatacgcttttgtaggaatgaatttgaaaggtagtttgtcagtaaacgaaagcacaacaactaatctcaaatctgttttgatggtgtgataggaaagaaagtaaaacctatgtgatggaccctgtaattggggcaggaatctcccaaagaaaaaggggagaattaatgacaaatgtcatagatcttgaaatttaatttagggtgcattttgtttatgaaacaatttaataaggcaacaaagtgaaatgatttttcatgtagcttatacacatgtaagtgcctctgattcatggtaactaacgtacctgatggtgtgtaaagtaatactgttgtcagaaggtttgccaattaagataatttgagtttactctttttttgttggttagtttagctgaaggcttgtcaattttattgatttttttcaaggagccaaagtggattttggggttttctctattgtgtttgtattctctatgtcatcaaactctgctcaaatcttacaaaatagtaagattagtaagaaagcagactaacttctgcttgctttgtatttagtttgtgtcttttccagtattttaaggtggaaggttaggttattgatttgaattcttttttgaataaaggcattaacagtta

SEQ ID NO: 3173 - DNA, 1825 bp, Homo sapiens
  ENST00000524872
cctcgctctgctggggcctccggacgcgcttcccacgcgggtctctggaacactcggtccgaacgcacgcctgcttgcactcacactgcggttcacacccggaggcgctctcgcactcacactgccgctcacgcgtgctcacactcccccacgcgcgctccgctccggctccagccccgcgcccagcgaaggcgcaggcactgctgccgagagcgccgaggggccccgcggccttcccatggcggacctgagcttcatcgaagataccgtcgccttccccgagaaggaagaggatgaggaggaagaagaggagggtgtggagtggggctacgaggaaggtgttgagtggggtctggtgtttcctgatgctaatggggaataccagtctcctattaacctaaactcaagagaggctaggtatgacccctcgctgttggatgtccgcctctccccaaattatgtggtgtgccgagactgtgaagtcaccaatgatggacataccattcaggttatcctgaagtcaaaatcagttctttcgggaggaccattgcctcaagggcatgaatttgaactgtacgaagtgagatttcactggggaagagaaaaccagcgtggttctgagcacacggttaatttcaaagcttttcccatggagctccatctgatccactggaactccactctgtttggcagcattgatgaggctgtggggaagccgcacggaatcgccatcattgctctgtttgttcagataggaaaggaacatgttggcttgaaggctgtgactgaaatcctccaagatattcagtataaggggaagtccaaaacaataccttgctttaatcctaacactttattaccagaccctctgctgcgggattactgggtgtatgaaggctctctcaccatcccaccttgcagtgaaggtgtcacctggatattattccgataccctttaactatatcccagctacagatagaagaatttcgaaggctgaggacacatgttaagggggcagaacttgtggaaggctgtgatgggattttgggagacaactttcggcccactcagcctcttagtgacagagtcattagagctgcatttcagtagccaaagaggacaggaacaagtctgtcttcatgagggtatgtccagattaagtaaggaaaatgaggtgcacagctacttaaacctagcgtaccaaaggtacacttattgtgatcctggtaatttagtaataaaagcgtatgtacttcatcttgataaaatttatgacacattcttgagctctgttaattacaggtcaagtaggtattttaattttatgcagtattgaagaaaaactatgattatattttcctatcagagtagcctttaattccaagttttggtggctttcataagaacagacaccctcaggcccagaaaaagtgacatgcatgcatacctctttagtaacttaccatgttgtccccgtgaagcagcaccagtcatgtcccagtgaccaaggagcacataggaggggacttggggagcgtgtgagcctcagtgtggacccttctcgtctcctgcagaattgatcctcttgtttctcaggggagggagcatatctggcatgcattgaaatacttcttctatggaagtgccttttatatgataaattgagaagcacttattaattatctgaatatgatacactattgattgaaacataatctatgtattttaatatatagaattcaatgtatgtattccttactcttaaggaactaacaaaataaaatatcacaaacacggaagagataaaatataaaacaaactata

SEQ ID NO: 3174 - DNA, 510 bp, Homo sapiens
  ENST00000528666
gaaagataactgaatcaatgtgaagtctgtgagtccctccagttgtcttcctcctcatcaggactaaaactggacttaagaggcagtgatccactaagcactgcttctgttcagaaataagaaggaaggaattcatacagagaactcgtattaagccagtagtttgtgtctacttgtgatcctcttgtgctccatctgatccactggaactccactctgtttggcagcattgatgaggctgtggggaagccgcacggaatcgccatcattgctctgtttgttcagataggaaaggaacatgttggcttgaaggctgtgactgaaatcctccaagatattcagtataaggggaagtccaaaacaataccttgctttaatcctaacactttattaccagaccctctgctgcgggattactgggtgtatgaaggctctctcaccatcccaccttgcagtgaaggtgtcacctggatattattccgataccctttaactatatcccagctacag

SEQ ID NO: 3175 - DNA, 1697 bp, Homo sapiens
  ENST00000529918
aacgcacgcctgcttgcactcacactgcggttcacacccggaggcgctctcgcactcacactgccgctcacgcgtgctcacactcccccacgcgcgctccgctccggctccagccccgcgcccagcgaaggcgcaggcactgctgccgagagcgccgaggggccccgcggccttcccatggcggacctgagcttcatcgaagataccgtcgccttccccgagaaggaagaggatgaggaggaagaagaggagggtgtggagtggggctacgaggaaggtgttgagtggggtctggtgtttcctgatgctaatggggaataccagtctcctattaacctaaactcaagagaggctaggtatgacccctcgctgttggatgtccgcctctccccaaattatgtggtgtgccgagactgtgaagtcaccaatgatggacataccattcaggttatcctgaagtcaaaatcagttctttcgggaggaccattgcctcaagggcatgaatttgaactgtacgaagtgagatttcactggggaagagaaaaccagcgtggttctgagcacacggttaatttcaaagcttttcccatggaggtaagaataacaaatcatcttgtaaaaatcttgttttctgaataaagtattcagcgatttactgaaaatgatttagtttaaaagtagatgcatagctcttgaattttatcagtttatactaaaatttaaaaaatgcttaatgcaatggaagcctagggcagcacatgaaacctcctgtctactctcgtggcttggcgtgtgcgcatgagcacatggccagaaaggcaatctacagtattaaatttcaccctagtgttactattcttgtaaaaattctgcctctgcaaattcagtaggtcatttttgtggatgctttggataggtgacgagctgaagacaagcaaccgttggagaaacctcaacagtaatgaaaagtgtaggtttgctagtttaaaattggtgggttggttttattcaccccaagccacttggggagggagggagaaagagagattttttgagagtgattcttttgtccaaagaattccctccccgacttacgttcttagttaacttctgctgtttctttgatacgcagttgaaatcttatgtcttctgtgggacttttctctagttttttccctaggcagaattcatctctctctctctgctccctgtatgcttgatagggcactgccatggcgctggccccatgggttgtaccatttagtctccacagcgtctttcttgctgcctgtgagctcctgaggaccgaagctccctctcaccccctttttactcccatcatttgcccactgccaggcacagtggagatagacagttcacactggtgaaagtgaggggatgttggattcagtccacgtcttgatgttatttctagaaggaacctcagtttaccccagaaaatagccctttggtgtcatgtaagagtatgttctgggggctgctggtcttccagtctttttttttgacattcacaactgtgcatgtgcttaatattaaatataaaattgctcatgaccagatgcaatatccagtaccacttcagtggctggaaatcatggctgtataattctatgtcagtgatacatgtattttagagtattctgttgaagtgtttgacagcattactgtaattataa

SEQ ID NO: 3176 - DNA, 1290 bp, Homo sapiens
  ENST00000461945
ttttgcggtttgggagggaggctgcgaggaggggcgcggtgcccgccgccgccaccgcagcaccgcacagcgtctctcctgggggtgcgacctacgccggggacccagcgctcgggcaccggaggccggcctcgcaccggtgcggaggccggctctcgcgagaaagcataaaggatgttattggcagaaagataaaaatttcagtgaagaagaaagtaaagttggaagttaagggagacaaagttgaaaacaaagtgctggtccttacatcatgccgagccttccttgtaacagcgcgaatccccaccaagctcgagttaaccttcagctacttggagattcatggcgtcgtttgcagcaagtcagctcagatgattgtggaaactgagaagtgcagcatttccatgaagatggcgtcacccgaggacgtgagtgaggtgctggctcacataggcacctgcctgaggaagatatttcctggcctctctccagtgagaatcatgaaaaaagtctccatggagccatctgagcgcctggctagtctccaggcgctgtgggacagccagaccgtggctgagcagggcccctgtggtggattttctcagatgtatgcctgtgtttgtgactggcttggattttcatacagggaagaagtacaatgggatgtggatacaatttatcttacccaagacaccagggaattgaatttacaagattttagtcatcttgaccacaggaaatccagaattgcagtgtggtccctgaagagctctagccaactgaatcggccagggaaaaagtatactagctggatatacctcctctttgcacagcctgggactacggaagatggtgaagcaggctcagctgtgtctgtagttgtggctgatgggcctaaagcctccagttctcaggcaattttttttttttcctgcttagagcagttctccttcttcctataagtgaggcaactttatactttcaaatttagacaagatgtttcctgtgtagctcataaaaaagtgaactgagaaagaaaaagggaaaatattttactttgtaagtattttccaataaaacaagaaaattgcacgtggaataagatagaagtttacagtcctccagtgtttggtctcagcgtttttggtccctttacaatcttaaaaatgatcgatctttggtttttgtgggtcaaaacattggtatttacaatattataaattaaaactaaaatttgaaatatttattaattaaaaagtgacactaataaagcaaaccattacgtactaa

SEQ ID NO: 3177 - DNA, 5431 bp, Homo sapiens
  ENST00000329474
tgggcgggagctacgccggcccaagccccgccggggaccagcgagccgggaggaggagcaggcgccacagccgccccgcgccccgcgcccgcttgtaatccggtccgctccttattcagccgccgggaactgcgaggaggcgtcatgtagcagcagcagcaaatccgcctcgcatttgcaactcttttttttttttttggtggggcggggggcgcgcggcaaaattctgtctccgcccccccttttcttgcccacttccatttgcaagctgcatctgcctctctaaaaaaattgaggagttcggggaagggcagggggccataaatcagagttggacctgcaataacccccacacctacagggcaaccatgaccgaggagagctctgacgttcccagggagttgatagaaagcataaaggatgttattggcagaaagataaaaatttcagtgaagaagaaagtaaagttggaagttaagggagacaaagttgaaaacaaagtgctggtccttacatcatgccgagccttccttgtaacagcgcgaatccccaccaagctcgagttaaccttcagctacttggagattcatggcgtcgtttgcagcaagtcagctcagatgattgtggaaactgagaagtgcagcatttccatgaagatggcgtcacccgaggacgtgagtgaggtgctggctcacataggcacctgcctgaggaagatatttcctggcctctctccagtgagaatcatgaaaaaagtctccatggagccatctgagcgcctggctagtctccaggcgctgtgggacagccagaccgtggctgagcagggcccctgtggtggattttctcagatgtatgcctgtgtttgtgactggcttggattttcatacagggaagaagtacaatgggatgtggatacaatttatcttacccaagacaccagggaattgaatttacaagattttagtcatcttgaccacagggacctaatacctatcattgctgctctggaatataatcagtggttcacaaaactgtcctctaaggatctaaaactgtccactgatgtctgtgaacagatcttgagggtggtgagtaggtccaatcgactggaagaattggtgttggaaaatgctggacttagaacagattttgcacaaaaactggccagtgctctagcacataatcccaactcaggactccacacaattaaccttgctggcaacccactggaggatagaggtgtgtcctctttaagtattcaatttgccaaactcccaaagggattaaagcacttaaatttatctaaaacctcattatcacctaaaggggtgaacagcctttctcagtcactcagtgccaatccattgaccgcctctacccttgtccacctcgacctctcagggaacgtccttcgtggagatgacctctcacacatgtataattttttggcccagccaaatgccattgttcatctggatttatccaatacagaatgttccctggacatggtctgtggagctcttctccgtggatgccttcaatatttagctgtgctcaacctctccagaactgtcttctctcaccggaaaggaaaagaagtacctccatctttcaagcaattttttagtagttctctggctttgatgcacatcaacctttcaggcacaaaactgtctcctgagcccttaaaagcactgttattgggcctggcttgtaatcataacttgaaaggggtttctctggatctcagcaactgtgagctgagatcaggaggtgctcaagtattagaaggttgcattgctgaaatacacaacatcaccagcttagacatctctgacaatggtttagaatctgacctatctaccttaatagtgtggctcagtaaaaacagatcaatacaacacctggcgttaggcaaaaattttaataatatgaaatccaaaaatctgacacctgtattggacaacttagtacagatgattcaagatgaagaatcacctctgcagtccttgtccctggctgactcgaaactcaagactgaggtcaccatcatcatcaatgccctgggaagcaacacctccctgaccaaagtggacattagcggcaacggaatgggggacatgggagcgaagatgctggccaaagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagccagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaagaatccttagagatcgagctggctgaggagaagccagttaaacgttccatcatcacagtggaggagctaacagagatagagcgtttggaagatctggatacctgtatgatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagagaagagagctgcgtgtgcgcagaagaagcttgggaatgatgccgtatcccaggattcttccagcccagctttgagcggcgtagaacggtcggatggaggtggggcagtgcctaaactgcacccaggtcttccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatagattatatatattagatcttgggtatggtttttaccttctcccatggggaacttcttccttcctgatgtggaattgtacatttaaagcttggtcggtgacctttgcataccatcaacgagcacagctaagaacagagtgagagaggcccatggctgattttaccatgtgcccagattaatgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaa

SEQ ID NO: 3178 - DNA, 707 bp, Homo sapiens
  ENST00000497227
tttatgaaggagagatctaaagaaataagacttgttattggtatggacttagaggtaggatttctctcagagcaaggaggtttttcaagcaaattctgataccaacctctttcctttggaagtaggaaacagagtccctagagacaatttacttcaacttttgggaactttgaagatcagtctttgagaacttagttgttgtctagtggccaactagatgttgtgtttctgaataatagaaattaacaggtgaacttggatgtcatggattaaaaattaagtgtcagtgtagctactgtaggagcactttcatgtactttgttgtttctgcttccagggacctaatacctatcattgctgctctggaatataatcagtggttcacaaaactgtcctctaaggatctaaaactgtccactgatgtctgtgaacagatcttgagggtggtgagtaggtccaatcgactggaagaattggtgttggaaaatgctggacttagaacagattttgcacaaaaactggccagtgctctagcacataatcccaactcaggactccacacaattaaccttgctggcaacccactggaggatagaggtactgcagagttctcattatcattgatgccagaattgtaagaggattagagaattttaatttagccatgcctgaagagctgtatcaagctaagttgtaattataagtgc

SEQ ID NO: 3179 - DNA, 3201 bp, Homo sapiens
  ENST00000635618
gaagtacctccatctttcaagcaattttttagtagttctctggctttgatgcacatcaacctttcaggcacaaaactgtctcctgagcccttaaaagcactgttattgggcctggcttgtaatcataacttgaaaggggtttctctggatctcagcaactgtgagcttggccattgtctgagatcaggaggtgctcaagtattagaaggttgcattgctgaaatacacaacatcaccagcttagacatctctgacaatggtttagaatctgacctatctaccttaatagtgtggctcagtaaaaacagatcaatacaacacctggcgttaggcaaaaattttaataatatgaaatccaaaaatctgacacctgtattggacaacttagtacagatgattcaagatgaagaatcacctctgcagtccttgtccctggctgactcgaaactcaagactgaggtcaccatcatcatcaatgccctgggaagcaacacctccctgaccaaagtggacattagcggcaacggaatgggggacatgggagcgaagatgctggccaaagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagccagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaagaatccttagagatcgagctggctgaggagaagccagttaaacgttccatcatcacagtggaggagctaacagagatagagcgtttggaagatctggatacctgtatgactctctgctgtacaagtatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagagaagagagctgcgtgtgcgcagaagaagcttgggaatgatgccgtatcccaggattcttccagcccagctttgagcggcgtagaacggtcggatggaggtggggcagtgcctaaactgcacccaggtcttccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagcatgcccaactaatttctgaaacagtagtgcaaagaggagattattacaaaagacattcagatcatgacagtggcaagccttccagtagagggaaaagatcttcaaaactgtactccaccattgcagaagaggaagtgaatgcaattgggcacaggaagtcacagccaacaaatgtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattct

SEQ ID NO: 3180 - DNA, 1291 bp, Homo sapiens
  ENST00000476458
acaaagagagagatggccagagtagcccccagcccagccccaggacattttcacaggaagtgcaaagaggagattattacaaaagacattcagatcatgacagtggcaagccttccagtagagggaaaagatcttcaaaactgtactccaccattgcagaagaggaagtgaatgcaattgggcacaggaagtcacagccaacaaatgtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatagattatatatattagatcttgggtatggtttttaccttctcccatggggaacttcttccttcctgatgtggaattgtacatttaaagcttggtcggtgacctttgcataccatcaacgagcacagctaagaacagagtgagagaggcccatggctgattttaccatgtgcccagattaatgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaa

SEQ ID NO: 3181 - DNA, 368 bp, Homo sapiens
  ENST00000525907
caattctcctgcctcaggctcccaaagtgctgggattataggcagccaccgcaccaggagaggctggatcttatagacatcctggcccctgtgtgcaagtccactgggtccagaagtgaggagggggctgcacagatgtgtggagaccctggcccaggagggcctctctgggagaacgtgcaatagggcaaagcgctggcagctgggacagaaagctgcagggctgggacctccggcctccatccaaagccctacgtctgtgaccctcgacgacagtccctgtccatctgtacctggccctctgtcgggacttcctctgtgtctctgaagacccccgtctctccctgcctgctccgtgccctcctcct

SEQ ID NO: 3182 - DNA, 546 bp, Homo sapiens
  ENST00000529925
atggcagccctacgtctgtgaccctcgacgacagtccctgtccatctgtacctggccctctgtcgggacttcctctgtgtctctgaagacccccgtctctccctgcctgctccgtgccctcctcctgctgggtccgtgtcccgccacacgcccccagtctctcagccactccacccacgagatgctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccggg

SEQ ID NO: 3183 - DNA, 2968 bp, Homo sapiens
  ENST00000531040
gctgtgccactgccaccgccgccgccgctgcatcccgcccggtccgagtccgcccgccacgcccgccgagccgctgccgccgccagtctctcagccactccacccacgagatgctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctct

SEQ ID NO: 3184 - DNA, 2369 bp, Homo sapiens
  ENST00000531958
gctgtgccactgccaccgccgccgccgctgcatcccgcccggtccgagtccgcccgccacgcccgccgagccgctgccgccgccagtctctcagccactccacccacgagatggtgagtcttctgtggtccctcccccacaaggcccaagtccctgggcagagagtgggcccagaggacagcaggcagcacctaggacctaagcctgggagttgccccctgcagacagcttagacccacgaccagctcccccacccccaccctgcggctgcatcctgggaggtgggcactcttagtgccctgtgacattcattcattccatggcccctcagggagctcaccttctaggagacggcacagaggctctggccctggcaaactgggattcgagcccaggcatgaggcccagtcctctgccgtctgggccacagcacaccatctcccaacaaccaagagattctcttcgtcccagcctcatcagcccccaggggatgggagagggcaggcaccaggcaacaaggtccaaagagacctcacgacttgctcaaggtggccgagcctgtcccctggaggacagactcagctgccaggcctgtccaggcctggggactgcaaagaacaagaattccattcacacgaagcctcccagcagccccatattgggggggcgccagcctcagagaggggagggacgttaggtttcatccaaagaaagcatttccgtgactcaaaatatctgcaggggggatactgtctagcctcctaatgtttagcccagggctgggcacacagtagggcttcaagacctacgtggggatgacagtggaatcacatttaggtgtcagcacactccatgccgggtcatgagacagaaataagccacctcagagtgatggctgggttcgttcattcatctactcttcagtcaacaaacacttactgagaagtggctgtgtgccaggcacgctttaggtgctggggttgcctccatgaacaaaacaagcagaaaactctgctgctgtgaagcaagctaaggcggagcccagcatggcaggggcgggaggggctggctggcaagacattgcttcctgccctccccccaggggcaccacacagaacagtttacaaagcactcccacggttgcgttcccattaacaagccttcgcccccaacacaagcctttcctctcctagtccccgggacggtgtcagccctgaacatagcccaggctgggagagtggggggcttacacccttgggtgacttaatgtgcccactggcccaccctgcccaagacctaccacttctgccctctcagctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaaaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagaga

SEQ ID NO: 3185 - DNA, 3942 bp, Homo sapiens
  ENST00000307823
gctgtgccactgccaccgccgccgccgctgcatcccgcccggtccgagtccgcccgccacgcccgccgagccgctgccgccgccagctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtgaa

SEQ ID NO: 3186 - DNA, 5065 bp, Homo sapiens
  ENST00000531388
cgagatggtgagtcttctgtggtccctcccccacaaggcccaagtccctgggcagagagtgggcccagaggacagcaggcagcacctaggacctaagcctgggagttgccccctgcagacagcttagacccacgaccagctcccccacccccaccctgcggctgcatcctgggaggtgggcactcttagtgccctgtgacattcattcattccatggcccctcagggagctcaccttctaggagacggcacagaggctctggccctggcaaactgggattcgagcccaggcatgaggcccagtcctctgccgtctgggccacagcacaccatctcccaacaaccaagagattctcttcgtcccagcctcatcagcccccaggggatgggagagggcaggcaccaggcaacaaggtccaaagagacctcacgacttgctcaaggtggccgagcctgtcccctggaggacagactcagctgccaggcctgtccaggcctggggactgcaaagaacaagaattccattcacacgaagcctcccagcagccccatattgggggggcgccagcctcagagaggggagggacgttaggtttcatccaaagaaagcatttccgtgactcaaaatatctgcaggggggatactgtctagcctcctaatgtttagcccagggctgggcacacagtagggcttcaagacctacgtggggatgacagtggaatcacatttaggtgtcagcacactccatgccgggtcatgagacagaaataagccacctcagagtgatggctgggttcgttcattcatctactcttcagtcaacaaacacttactgagaagtggctgtgtgccaggcacgctttaggtgctggggttgcctccatgaacaaaacaagcagaaaactctgctgctgtgaagcaagctaaggcggagcccagcatggcaggggcgggaggggctggctggcaagacattgcttcctgccctccccccaggggcaccacacagaacagtttacaaagcactcccacggttgcgttcccattaacaagccttcgcccccaacacaagcctttcctctcctagtccccgggacggtgtcagccctgaacatagcccaggctgggagagtggggggcttacacccttgggtgacttaatgtgcccactggcccaccctgcccaagacctaccacttctgccctctcagctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtg

SEQ ID NO: 3187 - DNA, 3971 bp, Homo sapiens
  ENST00000445895
ccactcccaaagtctaggggctggaaggccaggcagggacttggctgccctgactccttcgtctctctgtccctctgtctctgccatcagtctctcagccactccacccacgagatgctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtg

SEQ ID NO: 3188 - DNA, 1451 bp, Homo sapiens
  ENST00000613512
ccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggaaaatgaaggcattatggtgtctatgaatctgctattagaaaaggtcaatttttgattaagaatatttttataccaaactgctcagctgtccaccttttcaaataccaggctaaaatcaatctcatatttttgctaaattaatgcttaataaatttttattataaaattgtgcttgttttctaattttgtcataaattaagtcatgcttataggagaaaaaattaagtattaaaaatcataaaaaatgaagaaataatcatcatcaacctttttaaaactattcataaaaactcaagttttttatatagcttatttattttgtatatccaattttgtgtgcttttattatattgttataacattactactagtaataaaactat

SEQ ID NO: 3189 - DNA, 1166 bp, Homo sapiens
  ENST00000458137
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagcttttctggaaatccagggtgcccaacccagtggcaagttaaagctttgtcctcatgctcacttccatgaactaaagacaaaaagggcagatgagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 3190 - DNA, 1306 bp, Homo sapiens
  ENST00000375726
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 3191 - DNA, 819 bp, Homo sapiens
  ENST00000447913
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 3192 - DNA, 1196 bp, Homo sapiens
  ENST00000446862
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacgttcaacattcatttgagaccccaaatatactgacccagctgcccaccattgaaagactatccatgacacgatatttctatctctttcctgggaattaaaactcataagaagcaactcaggta

SEQ ID NO: 3193 - DNA, 1168 bp, Homo sapiens
  ENST00000441710
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacgttcaacattcatttgagaccccaaatatactgacccagctgcccaccattgaaagactatccatgacacgatatttctatctctttcctgggaattaaaactcataagaagcaactcaggta

SEQ ID NO: 3194 - DNA, 709 bp, Homo sapiens
  ENST00000433738
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacgttcaacattcatttgagaccccaaatatactgacccagctgcccaccattgaaagactatccatgacacgatatttctatctctttcctgggaattaaaactcataagaagcaactcaggta

SEQ ID NO: 3195 - DNA, 1071 bp, Homo sapiens
  ENST00000448103
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 3196 - DNA, 1401 bp, Homo sapiens
  ENST00000417998
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagcttttctggaaatccagggtgcccaacccagtggcaagttaaagctttgtcctcatgctcacttccatgaactaaagacaaaaagggcagatgagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 3197 - DNA, 961 bp, Homo sapiens
  ENST00000494737
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacgttcaacattcatttgagaccccaaatatactgacccagctgcccaccattgaaagactatccatgacacgatatttctatctctttcctgggaattaaaactcataagaagcaactcaggta

SEQ ID NO: 3198 - DNA, 774 bp, Homo sapiens
  ENST00000508062
atggctgatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaa

SEQ ID NO: 3199 - DNA, 1685 bp, Homo sapiens
  ENST00000422698
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatggatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggaaaatgaaggcattatggtgtctatgaatctgctattagaaaaggtcaatttttgattaagaatatttttataccaaactgctcagctgtccaccttttcaaataccaggctaaaatcaatctcatatttttgctaaattaatgcttaataaatttttattataaaattgtgcttgttttctaattttgtcataaattaagtcatgcttataggagaaaaaattaagtattaaaaatcataaaaaatgaagaaataatcatcatcaacctttttaaaactattcataaaaactcaagttttttatatagcttatttattttgtatatccaattttgtgtgcttttattatattgttataacattactactagtaataaaactat

SEQ ID NO: 3200 - DNA, 2624 bp, Homo sapiens
  ENST00000393585
atccgtggccacagctggttggcgtcgccttgaaatcccaggccgtgaggagttagcgagccctgctcacactcggcgctctggttttcggtgggtgtgccctgcacctgcctcttcccccattctcaatgagatcaccatcctcagaataatttgtaccccgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 3201 - DNA, 2673 bp, Homo sapiens
  ENST00000308394
acatctcccggcggcgggccgcggaagcagtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 3202 - DNA, 2540 bp, Homo sapiens
  ENST00000523916
aggggcgggcgggaggcggggctggcgctggagcacatctcccggcggcgggccgcggaagcagtgcagacgcggctcctagcggatgggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 3203 - DNA, 964 bp, Homo sapiens
  ENST00000517513
agtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttgg

SEQ ID NO: 3204 - DNA, 677 bp, Homo sapiens
  ENST00000393588
gcggaagcagtgcagacgcggctcctagcggatgggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccg

SEQ ID NO: 3205 - DNA, 549 bp, Homo sapiens
  ENST00000447121
agtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcgttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgc

SEQ ID NO: 3206 - DNA, 684 bp, Homo sapiens
  ENST00000525116
gatgatttcactatcagtaggcacattgttgaatgacactggagagaaagaaaagtggtgtgtgtgtgtgtgtgtctctctctgtgtgtgtttgtatgtgtgtgggtctgtatgtatgaaactagtaagaatgaacattcaaaaagaacaaggtgggcaactgtgacagccattctgtgggaggcacagcagtgtgcagaaagttaatgtctccatagcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 3207 - DNA, 2158 bp, Homo sapiens
  ENST00000444739
aaatgagagctctgtctgtaaactctaggtggagttgctgaaattcctgcaagcatttcttgccgggagaggagggatggatcccggtcccacctaaagaagcagtctggccatgatctgccacagcggctgtgctgcactgtgaagactgctgcccagtccaatctgcccagcctccctagcactggtagggaaaaaccgctgactagagctgcagtaatggcagtcgcccctcccctggggaactcggtcatctctggcgtactccaggctgctatgctggctagtggggattctaatccagcggatctaagcttgcaggcttctgtgagaatggacctgctgcaaggccattttgctccctggcttcagccccctttccatgggagtggacgggactcctgcctcactagagttccgggagctgctggactatgtaaaaactcctgcagctcagtgcctgcccaaaaagctggaaatatgaactattgggttaattcttatcaggaaatgaaaaagagttgttagattaaacttcttcagtcattgtcgttctttgtaatcagagaaagaaaaactgagagatcaggaagagaagagacagatggatagaagaagtttgggtggccacaggaaacaagaaaagaaacaagctgaggtgtcaacccacaggataatattttgtcattttcatttttttcccccaagtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 3208 - DNA, 1340 bp, Homo sapiens
  ENST00000393150
cagaagcctttgtgatctcacctgttggaatgcactaatgttttctgagccccttaaatatcttgtctacattcttttaagaagctcttcaccaactgtcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacg

SEQ ID NO: 3209 - DNA, 215 bp, Homo sapiens
  ENST00000533252
acaacgtgtcctggagagacagcacaatgggctctatcttcatcacacaactcatcacatgcttccagaaatattcttggtgctgccacctagaggaagtatttcggaaggaagccacaagcagcccagccctccttaatcaacttcaaggagcaccttcattagtacagcttgcatatttaacattttgtatttcaataaaagtgaagacaaac

SEQ ID NO: 3210 - DNA, 4745 bp, Homo sapiens
  ENST00000529565
cagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtggtgagtgctgagactgaacatctaacagttatgaaggtgtatgcagaggattgtgatgtttggtttatatttaggggcaacattcttaaacctcatccagtgtaaataaagtacattgaattctaaagaaactctacctaagggtctggtataacaagaaattgtctcatcaaaattagtggagaaatttctgttcaattttatccacagtaagtggtgaaggagatcatcagaatccctaaatcaaagttaaacagaaatactcaaactttggaatggaatcattttcatgatagcttgatttgtaaatgttttacagaaattttgacattgtgtggtttgagaagaatttcatttgaaactggggccattatgtaaaacagcatccctttttcttataattattgagggggaaattagtaaagagatcaggggactgtagaatgttgcagtgccactttgctccaaagattcaattgcctcatggctggctgaggatggtggctcatgcctataatcccaacactttgggaggccaagacaggaggatggcttgaggccaggaatttgagaccaattgtctgatagctcttgggagctatttttcaaaagaaaacagattttttttctagaaaatggtaaattcaagatgatttcactatcagtaggcacattgttgaatgacactggagagaaagaaaagtggtgtgtgtgtgtgtgtgtctctctctgtgtgtgtttgtatgtgtgtgggtctgtatgtatgaaactagtaagaatgaacattcaaaaagaacaaggtgggcaactgtgacagccattctgtgggaggcacagcagtgtgcagaaagttaatgtctccatagcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacgtatgtatctttcagtggcagtaagggatttgtgggcctgaggccatctttgaatgaatctagaaaatcaagaatccctatgaaacaatgatctgatagaatgttgtgtgctctccacatattttacatgatcttatgtgtgccgtgagaacagattcctaaagcaacccgatacatggaaacccattcaccactcaccatttaaacagatgatgaattctgttttttttattaagcccatttaacattttacatagtgtttttatggattccaggaatggcttctctttctcaaatgatcaacttcaagtcttctttccatatttcacatctgattctacaatgagcagtgccattgcatgccctgctagaactgtggataccctttaaaacaagtagaaaatgatagggtggggctgattaggtctaatctcagggaacactggttagtatttcatgtctaggtaattatcttaaggagcgtacatttaactgtttttgatttgtatatttttaaatcttattttttaaaaccactttattgaggtatgattgacatacataatgttacatatttaatgtatacaacttaatgagtttggagatttctatgtactcctgaaatcatcaccactatctatgccataaacatatctctcttctccaaaagattcttacacttctctgtttattattatcatcattccgtgactgcgtgtgagaagtatacttagcataaaatctactctcttaacaaatttcaagtacataacacaatgttggttactactggcaccaccctgtacaatagatttttatcacttttttcagcttctatcactgaaacttgtcatgtgttcatctatttctattatacggtgaaagacagtgtggcataatctgcaaacaactttggagcctggtggcaattttttgttgcttactcactgtgtgaacatggggaagttccttcatctttctgtgcttctatttcttcctctgtaaagtgggataattctagttatttctcaagcccctataaaagctgagagaatgaacatgagttttgtagtagaaagccaatcccaagaatcaaaatttcttcaatacacaatctcttgcaatgcttaccaactgcaacttttgatcaccttttgctaggttttctgtttacgttctgtggaaagtaggtaaatgtcaggttgtaagtgcttcctacaaatctgtaaagataattcccaagctatgcttttctttttaaaaacattctcaaaacaaaaatatgaacaaaaacatagtgaaagtcatagcccaaggcatacccatctgtatcattatagacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggttaagtattgagagttgttggtggtatgtgaaataaataagagagtgatattggtggttaagttcaatgacaaatgacagctgagtacttggatggtcaaattggtgtttttgttgatatagtctggtgattatctgctacttctttccgacttacatgtatttggattcctccaactctacaattaatcaggcaatcaatcaatcaatcaaggaggtaaggaaaaccgcagcagaatgtgatgatgaaaaaccaaggatagtaattattaaaatagaaacatgctcatgcttccattactatttatattcatttatctctcatagtctttctcttttattcccctttcttacacacacacacacacacacacacacagagagagagagagagagagagagacactaagtagccaaacattgcatcaaaccctaaacaaaacagagtaaacaaaggagctaactctggagaaagcagcattttgatcctctgagtgaggatgtcacagcaaataccacattactgacatccagataccattaccagatggtacagaatacatcctacactgtagagtttgtgttgatccaggctctggttctcagactgttctcacaatgcagatcaccaatcactcagggttggcttttgaatcttcaatcacagtccagaagttccttcaagctcccatgtaacttttgttattattttgaccaaaatattatagaatgggtacattgagtctggactaaatgatgactttcttcactcataatagctttatttaacactagactataagactattatcaatctccctctaagatacatacttaaaattatattttatagtgaaatgtataaagttgttctcaatacttccaacatttaccacataatttttactcttggtttctgacacttcagtcacaatattgcatcatttcagcataacagctttcagtgcctaatccatccagtggggctgcatttggacattgaattgtttgttgactaatatttgccaacactaactgtgcaccaggttttgttctagatgcttggaatatgccaattaacaacgtaaatagatttcttacactctgaaagcttatattctagtgagtagaaacagactctgaagacataaagtggtaaatatatcacaggccggagagcaaaaaaagataaaaggaaaaataaaggaagacaaaggaaaacacagaatgatggatgctgtactcctatagatatttcactcaaaagcttttcttgaaataatgaaatcagaacaaagaatggacagagttggggagtgaataatgtggttcttatgcaggaaaagtgttccagcacagaatacagccagtgcaaatgccctgggatagcaatgcactaaacatgtttaaagaactgcaatgagacagtgtgaccaaaagagaacgtgagtggagaaaatggcagagacaaattaggagaagcagtgagaagccagatcgcgtggttctatgttatcacatggtaaacctttaaaaattattatctgagcgagacaggaagcctttctagtgctttagaaaaaagaagtaatatgctttaaattaggttttacaaagatcacattttggtgaatagactaagatgtcacagatggaagtcaagggaagtggcaagagcacatggaagaggatgcaagaagaatcatgatgagggatgggatgaaggcagcaaggggtaaccatcttgaccttctgttttttctctcccctgcaggaagccacaagcagcccagccctccttaatcaacttcaaggagcaccttcattagtacagcttgcatatttaacattttgtatttcaataaaagtgaagacaaa

SEQ ID NO: 3211 - DNA, 481 bp, Homo sapiens
  ENST00000530309
gttctgtggaaagtaggtaaatgtcaggttgtaagtgcttcctacaaatctgtaaagataattcccaagctatgcttttctttttaaaaacattctcaaaacaaaaatatgaacaaaaacatagtgaaagtcatagcccaaggcatacccatctgtatcattatagacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagac

SEQ ID NO: 3212 - DNA, 1214 bp, Homo sapiens
  ENST00000533730
aaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaaggtgataaattgggtcacagaggcagaaatcacaatttatgttctgcaatatcctgcagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattga

SEQ ID NO: 3213 - DNA, 771 bp, Homo sapiens
  ENST00000534356
ctgtgacagccattctgtgggaggcacagcagtgtgcagaaagttaatgtctccatagcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtaagtgtctcttttctagttactcatttatttcttcaggaagaatttgtcatgattcactttttacttcacaatgacaatttttgtcagggaagtgaaagtagagaggtacccagtttctgtcattcagttgtttaaaatatggctaaggaaaagacaattccaatatatcccagcagaagatcaaagtaaaataaaataatatcaaccataagctttatgttatggagcgtaagttcttaagttttagagaaggaaaaatattttgaaataatttttatttcttaatttattaaatgaataaaatctgggtggtctgctaggtcatggatttcctcctggtgacagaggggtaaatgaggcctacatgacgtaatcctatctaggactcacattttcgtgggagatatggatactgaaaatgtgggttaacaaacaaatatgtgcttacagattgtg

SEQ ID NO: 3214 - DNA, 612 bp, Homo sapiens
  ENST00000529183
ctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaaggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacc

SEQ ID NO: 3215 - DNA, 978 bp, Homo sapiens
  ENST00000524843
atttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtggtgagtgctgagactgaacatctaacagttatgaaggtgtatgcagaggattgtgatgtttggtttatatttaggggcaacattcttaaacctcatccagtgtaaataaagtacattgaattctaaagaaactctacctaa

SEQ ID NO: 3216 - DNA, 667 bp, Homo sapiens
  ENST00000531333
acaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcat

SEQ ID NO: 3217 - DNA, 763 bp, Homo sapiens
  ENST00000417440
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgacca

SEQ ID NO: 3218 - DNA, 921 bp, Homo sapiens
  ENST00000531546
gactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagaggtgctatgctatctatatgaaatagaaaaaaaagaagagatatcattgctttccttcagtgcaccatttcttacagcactaaatgattgggggtggggatgacagtaaccattttcaataatgcttttactaagggaaagattatgtgacttcacaatgataccaatcctttctcaatccatgatgcagatcattttatcatgagttgaaagaaaattggtatttctattgctcctgtatttattcttgtaattatttggattttatggcaattgtagcattagccatggaataaacatatttggaggataatatagctgacttgtaattggttgcactctacttgaaaagtctagacatgaaggatacttgggaaatataattaaagcttgaaaaacattataaatttatgtgttaaaaatagtaacaaaatagctatgcttccgaaggcaaagacttttgctgtattcatttttcactggagtcaacgacaacatct

SEQ ID NO: 3219 - DNA, 4463 bp, Homo sapiens
  ENST00000546424
ttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtgagtgctgccttcctctgcaaaggagaggggaggctgctgaggggcagcgtgtcctcctggggctggggatttggggtgagcagggcaggcccaaaccaagggtaaaaggtagtagactcctgcctctgagccttggagtcggcacttttgtgtctctttatgagaggcatcctgcctgtggtgacgtttgccctttattcaaagagttgccttccctgtctcctccaaggtccccaggttgacacctcccgctcctccactgatggagctggtcctcagtgccagcgcaggatggctctgtccagaccctgaaggcgggtcatgggcccctccctatatcctgtgggcatcatgtagtcttctactcttgaccctcaagaattgtgaacccctccttgtacatcgccttctcaggaggccccagtgaggaaacagatagggaagggtggcctgataggcccagtcctactccatagaaacccgactcagagcagttgcttcctctgagggtcctgtggccttgtggctgccttgggaggcagcatgtatgggccccagctgctctgctcaggtattcatgccacgagaaggggctgcgaggctggggccactcctggctccttgcaaatatttcagtctgatttgaactttatgaatttggaaattttgaattttgagttttttaaaggtaaagttgaggtgcgtattctttaagccctcctgctcaaagaggctgcagtttgagctgtttttaaggtgcgggttgagtggacattccccccagcccctcttgaattcttccttcagtccagagaactgaactcacagagctctccatggtcatgtcttacaggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctcttttgcctatttcttccctcattttgctccaactctttcttcttccttacaaaagagacttttgcttttttcgaaacatttccccatgtttttctggggtctcgctatgttgcccaggctggtctcaaactcctgggctcaagtgaccctcccaagtagctcttactacaggcgtgcaccattgcacccagccccatttattcatgtcttatttcacttgatccttatcccatcccaggaaggcaacaagggtgagaaccctgtgctcagggaggttaggtctcttgtccaagggaaaacgattatccagagaagagacctggccagaacctgggtcccctgagtcctagccatgcttcccatgtgccttacttgctgaagcacccccggactgcagtgtgaacgtgctgtgcaatagtgacacgctgggcttccccacaaggctccaccctgaggtcttttaagctgtccttatgccagcctatttcttgttttttgggcctttttttttggagatagggtctcactctgtcgcccaggctggagtgcaatgacgcaatcttggcttattgcagtctcgacctcctgggctcaagagatccttccacctcagccacctgagtagcttggactacaggtgtgcaccacctctcccagttaatttttgtatttttagtagagacagagttatgccatgttactcaggctggtcttgaactcctggactcaagcgatcagcctgccttagcctcccaaagtgcaggggttacaggcttgagccattgcgcctgacctatttctggttcttagggccctggatgttaggatggatttctgaattaataataataataaaaccctcatcaagatgtgatttgcatagttgtcactttatataatattattttccttctgtgacctttccaagtctgaaacagtcccagggacttcttttggttagttatttgcaatcacctgcaggacacacacacaagaaaattgtcaggttcacgtaaccacagagctgtgcgtggcagtttcctgtctctgtcctcctgggctaagctactcaagtgagtcacaggcagcccacactacagtagctcctgcctgaggagttcagatgatgtttcggagaaaaagatgcaatcacagcttttcattgacctgttagggtcttcctgtaaagggggtcttagccaggagtcctgtgtgggcttcaggtcagggggccttcgaaccccctaaaaattatatgccaaatgtgcggatggcatatttttagatttcatttgtttctcatcaaaactgctgtttgcaaggcagttatgcactgtggttggggctataactgtttccagaggctgttgatcagtatctgttaaactttttttttttttttttgagacagtcttgctctgttgcccagacgagtaca

SEQ ID NO: 3220 - DNA, 2019 bp, Homo sapiens
  ENST00000333868
ggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctc

SEQ ID NO: 3221 - DNA, 1621 bp, Homo sapiens
  ENST00000348549
gtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcgagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctc

SEQ ID NO: 3222 - DNA, 1878 bp, Homo sapiens
  ENST00000400777
agcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttgactgtcctctagggagcgtggggagagcccgggtttacgtgggtccctgtgctggcaggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagct

SEQ ID NO: 3223 - DNA, 740 bp, Homo sapiens
  ENST00000424908
ctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtgggggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacag

SEQ ID NO: 3224 - DNA, 1351 bp, Homo sapiens
  ENST00000375890
aattgaccctggggacagggcgaggcgcggaggcgtcctgaaggcgaggcggtgacgcaagagcgaatccttggggcggggcgaggcgttggagatgcgtcctgcgggcgggacggtaacgcgggggcggggcggtgacgtgagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgca

SEQ ID NO: 3225 - DNA, 1111 bp, Homo sapiens
  ENST00000474305
atggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataa

SEQ ID NO: 3226 - DNA, 954 bp, Homo sapiens
  ENST00000447522
gcgcggaatggattctggggtcggcgcgaggcgctgagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccag

SEQ ID NO: 3227 - DNA, 781 bp, Homo sapiens
  ENST00000440484
ttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaaggccagccacctgcagttcccaggggctgtctacggcacagatggatgccctgtgtcggtcgagaagattgtgaacatcttcaatgggaccagctgccccagcctgggagggaagcccaagctctttttcatcca

SEQ ID NO: 3228 - DNA, 569 bp, Homo sapiens
  ENST00000546969
agttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggtgagtctccatgaaatttgggccagtagctcgggctctgggcccttccctccccacccctcaggtccttccctgcaggtgtgtcaggagcccagggaacc

SEQ ID NO: 3229 - DNA, 725 bp, Homo sapiens
  ENST00000469637
agcaacagttgctaggatggggacgcactctctggtccctattctctttaaccctattcgtagaaccttagagcgtcagattggaagtgaccttagggattctttaactctccaactcctgcaatattgatagggagaccgaggtccagagaggggcagagatttgcccaaggcctagaatccagcattccttttatttttgtttacttatcttttttttttttgagagaatccaggacttttaatcccgtttaccgaaaaccgagctccacccaagaatgtaccagtctgtgccttaagcacggggaaagggcggtgggggtggagagagggataaggcacagggtcttgctctgtcacccaggctgaagtgcagtggtgctatcacagctcactgcagccttatctcctgggctcgagccatcctcttgggagcctcagcctcctgagtagctgggactacagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacat

SEQ ID NO: 3230 - DNA, 2674 bp, Homo sapiens
  ENST00000261448
tgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacagcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagagggcttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttg

SEQ ID NO: 3231 - DNA, 220 bp, Homo sapiens
  ENST00000488931
aaattctttgccacctttgacaaaggggtgctgtggctcacacctgtaatcccaacactttgggaggctgacgggggtggattgcatgagccttggagttggagaccagcctgggcaacatggttgcaaagaaattatctttgaagatgaatgaggttgacttctatgagccatttatggatgagcccattgccatccccaacaaaccttacacagaaga

SEQ ID NO: 3232 - DNA, 3626 bp, Homo sapiens
  ENST00000410018
gaagtcggctgtggaagtgtgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagga

SEQ ID NO: 3233 - DNA, 3746 bp, Homo sapiens
  ENST00000409235
gaagtcggctgtggaagtgtgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagga

SEQ ID NO: 3234 - DNA, 3501 bp, Homo sapiens
  ENST00000312265
aagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagga

SEQ ID NO: 3235 - DNA, 3785 bp, Homo sapiens
  ENST00000471517
ggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagacggagtcttgcgctgttgcccagactggagtgcagtggcgcgatctcggctcactgcaacctccgcctcccgtgttcaagcgatgctcctgcctcggcctcccaagtagctggaactacagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggtctgcgcgggaccagagtggagcccgaagggcggggcgagggctaccagaatctgggagcctggggggcggggacaccatcggaggggcggggcctgtctgtgagggaggccttaaccccgtttactgcccggagcaggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaataggtgagccagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagg

SEQ ID NO: 3236 - DNA, 668 bp, Homo sapiens
  ENST00000475343
agttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagtccccagtcaacttctaccgctggaagatagagcagctgcagatccagatggaggctgcccccttccgcagcaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtgg

SEQ ID NO: 3237 - DNA, 2634 bp, Homo sapiens
  ENST00000409410
ggaagagtcgtgggagctgggagaggagggaaagaggggaagagtcgtgggagctggcagaggagggaaagggggagccgaacgtgaagggcgaagggcggggcggggcaggagagtcggggtatagagcaggcaggtgttaatggcatgggaaggaagagtaagaagtggggcaagaaggtgtcgcggtacgaggggaaggtgagactcaagaaggtgccggctaagaagctggtgccggcgtggaaggagaaggtgtggggcgaggaaacaacgaagggcgaggaaagatcccgaggcgaagagacagttttcatcgagaaggggcagggcgaggaggaggggcgttaccagagggcgggacggggcgacgggcccgcgcgggaagaaccaatcgccgagaacccggggaaggaacgggtccataaagaccaagtggaggagtaggggcgcggtcaggagcggaagcagagtgaggagcaagccccgggcgagaaacgggggcccggccgggagcaagagcaggggcggggccgggagcaagagcaggggcggggcccggagacgggcgagaccaggtacagtacccagcccctgggcagaccccgagcgaggagaaagcggcgataccaagagaagttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccg

SEQ ID NO: 3238 - DNA, 653 bp, Homo sapiens
  ENST00000477793
agtccgtgcgggggcagggccaggagcaagagcaggggcgggaccaagagcaagtgcaggggcggggccaggagcaagagccggggcgtggccaggagcaagtgctgtgagaggcgcagaagcgaggtggaatcttaaaagtgggctccagagagctgtccggcgcgtgggtgttgactcctgcgttctccaggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagacggagtcttgcgctgttgcccagactggagtgcagtggcgcgatctcggctcactgcaacctccgcctcccgtgttcaagcgatgctcctgcctcggcctcccaagtagctggaactacag

SEQ ID NO: 3239 - DNA, 633 bp, Homo sapiens
  ENST00000466060
ctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcaga

SEQ ID NO: 3240 - DNA, 2899 bp, Homo sapiens
  ENST00000412458
cgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgaagacggggtttcaccatattggtcagtctggtcttgaactcctgacctcaagtgatccacctgcctcggcctcccaaagtgctggtattataggtgtgaaccactatgcctggcctaacctgcatttattggataatgaataaagaagggaataaatgaaagatgtgactttgtacctagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatc

SEQ ID NO: 3241 - DNA, 452 bp, Homo sapiens
  ENST00000475646
atcgcaacctggcaggggtgtggggtttgctgggggcctctgtggggccatgatctgaggagggtatgtggggggcgggagctcagcacattccatggcctagaggggccacacagaggccccagtgggacccatggcgtggaggcaggtatggggagttgtggggagatcccagggtggtctggggcctggaaccggccattgggaggccccagcagtttcagtgcccagggcctccctgcagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggaggtgaggga

SEQ ID NO: 3242 - DNA, 722 bp, Homo sapiens
  ENST00000488473
gagctcagcacattccatggcctagaggggccacacagaggccccagtgggacccatggcgtggaggcaggtatggggagttgtggggagatcccagggtggtctggggcctggaaccggccattgggaggccccagcagtttcagtgcccagggcctccctgcagagccatgcatggcagaagaagtgtgtagcatgagctggtacacgcccatgcccatcaagaaaggcagtgtggtcatgcgtgtggacatcagcagcaatggcctggggaccttcattccagataaaaggtaccctttcccaagacgggggctggggtggactccgggggaattcctcaccccagggtccccagaggagccagtgggagatccaagggagagaatggggagaggagaggcagctacgagctgtggaacccctgacactgggacctcacctgcgcctattctgcacctgctgctaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggtgaacggtgtggggcagatggtg

SEQ ID NO: 3243 - DNA, 737 bp, Homo sapiens
  ENST00000467739
tctcatcgaggcccttgtggcacactgtggaccagtcacctgtgcttatcctgggaggcattcccaatgagaagtacgtcctgatgactgacaccagcttcaaggacttctctctcgtggagacaggtaatgggccgacaccataacaaggcttgagggagacacatctcagatgacggtgaaaacccaatcgccacacgtagaaactacaagaagatcctatgatcctgttttagttctttttcttttttttctttttgtcatggtctcactttcttacccaggctggagttcagtgatgcaatcttggctcactgcagcctccatctcctgggttcaagccatcctcctacctgagcctccctagtagctgggactacaggcgcatatcaccatgcctggctaatttttgtatttttggtaaagatggggttttgccatgttgcccagcttggtcttgaactcctgacctcaagccatcctcctgcgttggcctcccaaagtgctgtgattacaggcatgagccaccgtgcccagccttgttcttgttctctaaccaaggagatttctccctgatggcctcatctgtttgtctcctctcttccctgctcctgtctctctccaccactcccttccacactgcccccaggaaacgaatcctcccctggctcatggttggggtccaggtatagatgctgtaacaaagagaccctggaagggaattacttaaacagaga

SEQ ID NO: 3244 - DNA, 541 bp, Homo sapiens
  ENST00000489693
agagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaaca

SEQ ID NO: 3245 - DNA, 567 bp, Homo sapiens
  ENST00000470292
atcacaccactgcactccagcctgggcgacagggagatcctgtctcaggggggaaataaaagaaaagaaactctaaggactagcaaacccgagtgggaagctctttggagggttttacaggaggctgagaagcaaacaacttgctccagctccaggttttgaaagtgcagggcctcaggagattttgctgtgttctccccacctgtagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggaggtgggctgccccgcccctctccccgttccctctctgcccacccccaaaccccaggggcccctcttt

SEQ ID NO: 3246 - DNA, 438 bp, Homo sapiens
  ENST00000585424
aacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggaggtgggctgccccgcccctctccccgttccctctctgcccacccccaaaccccaggggcccctctttcccccgtcacagtaaaggagccaagggaagggggcaccctcggggaccctgagaaagggcagtgaagctccatttataactgaaactcctggaactcagggtaagtgtcagctccaaagtcacgcagaccggagctatgatccgatgttcagaggcggccctctttcatcccacagtgtggtcgttcacttcataaatattgagcattta

SEQ ID NO: 3247 - DNA, 3761 bp, Homo sapiens
  ENST00000492088
attacgctcaaggataaaaagctttgctatgaccaaggcattagtggacatcaccttatggagacttccatgacggtcaatgtggtgggttcatccgggctctgcttccaggaaacacacctggggccccatatgcaagtattggagcttgggatactgggccctgggaggggaaggttggggtcgggtctcaacagggctaatccccctgagaatcccactaatgcattcataatttcctttcttctcattctttctcaacattcatccacccacccactaccacccactaactcctttcattcttttttctttaagacggagtttcactcttgttgcccaggctggagtgcggcggcgcggtcttggctcactttgcctccttggctcaagtgattctcctgcctcagcctcccaagtagctgggattataggcgcccgccaccacggctggctaattttttgtatttttagtggagacagagtttttccatgttggccaggatggtcacaaactcctaaactcaaatgatccacccgcctcagcctcccaaagtgctgggattccaggtgtgagccaccatgcccggcctaactcctttcattcattcacgttttcagaaagggccaccttcccagttgtgcaggttgcacacaaactggtatgttccctctgataacttttcttcagagggagaatagagtgagcaacagggccgttttttttttgttttttgttttttttttaacgatgtctcactcttgtcccccaggctggagtgcaatggtgcaatctcggctcactgcaacctccacctcccgggttcaagcgattctcctgcctcagcctcccaagtagctgggattacagttgcataccaccatgcctagctaattttttatattttaaatagagacggagtttcaccatgttggccaggctggtcttgaactcctaacctcaggtgatctgccggccttggcctcccaaagtgctgggattacaggtgtgagccaccgtgcccgacctagggccactttttgcaattggcacaaaggtggcataagggctggcctggccctgctttcacatctctctcttcttctgcccactcacacattcctcattcagttctttgggtgcttggtgcttcacttgcttatacacgtgatatcgcctttgcccggggcagacactgaggctcagagaggtgcagagtaacccagggagctaataagtggtagaggaggggcgtgccccagagttcttgttctcacccatttccctacccactccctggcatgcagatcctggtgttcctccctcctggcttagaatgaccttgggcagtcaaaaggggttgtaacagcccccacctccttagagtacatgagatttcatgtgctagactgaataaacaaggaggaagtgtgattgcatcagggtgggcaagggggaacgtggtgggatgagctcggagcagtgatggggcagagtaagcggagcccttatgggccatggtatgtgagctggctcctcgggagggctctaagcagaggagggactcgggtgtccccagggcccatctggctgcatggggtggggggacatcaatgaggggactggaagcagggagactctggaagagacaaggttggacaaaacagggtgggggcaaaggagttggaggtttaggggagagaacaggcaggctctcggtctttttttttttttttttgagacagagtcctgctctgtcacccaggctggagtgcagtggtgcagtcttggcctctacctccctggttcaagcgattctccagcctctgcctcccgagtagctgggattacaggcatgcaccaccacacacccagctaattttttgtatttttagtagagacagggttttactgtgctggccaggctagtctcgaactcctggactcaagtgatcagcccgcctcggcctcccgaagttctgggattacaggcatgagccactgcaccaggccgtgttaatgatattaatgaccatattgcccttgggggtgagggagagccaggcagctggtggtggtgtttgtgggagggggactgtccttcctgccccttacccctccaggggcctgaggagaccctggccacccctgtgagccttttttcctcccaccgagggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacagtgtgtgtccagtcccttcccctgcacagttcactgccctcttgcccccactactttgtgctctccctccccattcctctccccgcagactacccaccctttttcctgcggcatctcactttcccccgtctcggtcctcagcttctcgggccaagctaatttcttcttctggtctcaatcccctccaaccccatagttttctaccccttcttcttgattcaagatttggtgacaggagactccggcagtttccagggcaggtaaaggcgtggccagcttgcagctagggcaggtggagggagtggaaggagatgggtgcaggactcgagacccggaggccagtctgtgtgcacttctgtccctggtagctatgttctgctggtggtgggtggcgggcccacactggacagcctcaaggactacagtgaggacgaaatctaccgcttcaacagccccctggacaagtaatccccgtggggtcccacgtgtaatccaccttgcttcccctggaggcctttcccacttccaagccaagcccacctcgcaagcccccacctctgcgtctcaggccctgcccacagtggggctcttaggatctcacaggcaaactcctgcccgcccctaacaccatgtcccctgcacccacctgtggcctccctccacactgaccactgaggtcatacctcccctacaccgccccccaacccctggctgagatgacctgggcctgcacaggaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaataggtgagccagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcag

SEQ ID NO: 3248 - DNA, 2704 bp, Homo sapiens
  ENST00000341049
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 3249 - DNA, 598 bp, Homo sapiens
  ENST00000393470
agttcccttaaagcacagcccagggaaacctcctcacagttttcatccagccacgggccagcatgtctgggggcaaatacgtagactcggagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgatt

SEQ ID NO: 3250 - DNA, 1653 bp, Homo sapiens
  ENST00000451122
taaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctagggagcccctgagctaggaggacacggaaaaggggattggggtcctgagattgggtctgttgggcccaggacgcgttttctggatgggtctaggatgctcccttgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaa

SEQ ID NO: 3251 - DNA, 575 bp, Homo sapiens
  ENST00000489856
agcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaaggtaagccaaggcgaccaacagggaagggctgggacagctctcctctggcagttagcccgtgcatccttctttagcattgccgtgtacgcacaccccaccccgccccctacacgcgcacacacacacacacacagagttttgtgggtttgatgtgtgggagctcccgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttggga

SEQ ID NO: 3252 - DNA, 2443 bp, Homo sapiens
  ENST00000405348
gctgcccttcagccacccgcccgcagcctgggagtgccctgaggggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaa

SEQ ID NO: 3253 - DNA, 557 bp, Homo sapiens
  ENST00000456473
agcgataaagggaacattccacgggtcgggcggctgctgttggatcttagataaagctggaagggattaccggggcagggggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaat

SEQ ID NO: 3254 - DNA, 845 bp, Homo sapiens
  ENST00000393468
ggcaggcgcgccctgcagagtacagaggggtgtggtgtcctctgcgagatcctcttaaaaagctggctacgcgcaggcggtttctgtgcacggagccgtagctgtcggagcgggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttcc

SEQ ID NO: 3255 - DNA, 2628 bp, Homo sapiens
  ENST00000393467
agagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 3256 - DNA, 3201 bp, Homo sapiens
  ENST00000614113
taaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctagggagcccctgagctaggaggacacggaaaaggggattggggtcctgagattgggtctgttgggcccaggacgcgttttctggatgggtctaggatgctcccttgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtc

SEQ ID NO: 3257 - DNA, 714 bp, Homo sapiens
  ENST00000490906
attctaaccatgctggcagctgattagatggtgcccactcagattaaaggtattgggagaaggagaggctgtcaacccatgccactatgctatctctaattctgccatccagaccgagcaaacgtacttaagacctttgtgtaagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcaggacacagtgttctgcctctcctgagtaagcagcaacaacgcaccatcttggaatcaggggacggccctcaccagacaactaaatctgcagacaccttggacttcccagcctccagaactgtctttctggcaactgtctaaacataaaccagagaagggcaaggcagactcaggaaggacaaatagaaggctattttcataaatcgggcatacaatggtggacaaaacagctgcctttcttccccgtatggagcttacagtatagtgaatatttcatgggactagtatctacagaaggtgttttgggaagcacagctttggagagagtaatttgccaacattgcacagaataaaggcaccatgagggcccaaggaaggaaaagatttgcagctgtcttg

SEQ ID NO: 3258 - DNA, 531 bp, Homo sapiens
  ENST00000460222
gacttggactttgaggaaaatgagaaaccattggccagtttggggtattgggagaaggagaggctgtcaacccatgccactatgctatctctaattctgccatccagaccgagcaaacgtacttaagacctttgtgtaagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcaggacaatatcagaacggcacatacaagtgtccccaagtcatatttggaataagatcacttgggaacacaagtcaaagaaggacacagtgttctgcctctcctgagtaagcagcaacaacgcaccatcttggaatcaggggacggccctcaccagacaactaaatctgcagacaccttggacttcccagcctccagaactgtctttctggcaactgtctaaa

SEQ ID NO: 3259 - DNA, 1119 bp, Homo sapiens
  ENST00000477018
cccatgccactatgctatctctaattctgccatccagaccgagcaaacgtacttaagacctttgtgtaagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcaggacaatatcagaacggcacatacaagtgtccccaagtcatatttggaataagatcacttgggaacacaagtcaaagaaggacacagtgttctgcctctcctgagtaagcagcaacaacgcaccatcttggaatcaggggacggccctcaccagacaactaaatctgcagacaccttggacttcccagcctccagaactgtctttctggcaactgtctaaacataaaccagagaagggcaaggcagactcaggaaggacaaatagaaggctattttcataaatcggaccaccaccacatgtgcagcatccctctgggtctcttccatgacaaccctgtgggaagccagcttggcaggtcaccttgttctagcagatagaaactgaatcaatatgggaagagccagaatttggacaaggttcaccaaacattcacactgatgccagccattccacttccttggcctcagatattgggcacagtaacttccagttgttgggcaacaattctagaagagttccaattctcatcaggagaatggacaaggtggagaagcagagaaaatgcaatgagtagaatgtctaagtcatcactttggaattgactgaacataaataaaaatgagaaagatacgtaaaaaagaagggaatggatgccacagcccccattttgccaacgaggcagctgaggttcccagaggctcaataccagcaccatgagccgcagcacgcaaggcaaacacagccggaggattttaatgccttttgtaaagacctgcctaatggttctgccttcagtgcagacaatatggaagagtgtgacagatgttatcattgctccattgtgtacgagcgtaggacgatgcttctcttctgtcagc

SEQ ID NO: 3260 - DNA, 1200 bp, Homo sapiens
  ENST00000467035
cccatgccactatgctatctctaattctgccatccagaccgagcaaacgtacttaagacctttgtgtaagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcagactgctttttgccttctgccatgattgtgaggcctccccagccacgtgaaacccttggcaggtcaccttgttctagcagatagaaactgaatcaatatgggaagagccagaatttggacaaggttcaccaaacattcacactgatgccaggtgggccaagaaaaagggaatgtcctgcctctgagacatatgaaggagggtcttttcatattaaattgttttcctggcagcacctgaaccaaaggatcagacttaaaataagtctttttccaatgttatgttgaaattggatacgacatttctcacaaaacttctaagtcaaacagtgatgagaaactactgcctaaaagtgggcctacatcaaatcgttatggtctcgtaccaagatgtcttttgactgaggaagctaagaatacggctccttgttctcaccagtggactcctcctcagcagcaggggctcccttccccactacccatgagggagatggtggcagttcaacaggaaaatgttgatattatggattcccataaggattcatgtcttctattcactttaatgaacagttgttgggcaacaattctagaagagttccaattctcatcaggagaatggacaaggtggagaagcagagaaaatgcaatgagtagaatgtctaagtcatcactttggaattgactgaacataaataaaaatgagaaagatacgtaaaaaagaagggaatggatgccacagcccccattttgccaacgaggcagctgaggttcccagaggctcaataccagcaccatgagccgcagcacgcaaggcaaacacagccggaggattttaatgccttttgtaaagacctgcctaatggttctgccttcagtgcagacaatatggaagagtgtgacagatgttatcattgctccattgtgtacgagcgtaggacgatgcttctcttctgtcagcctgca

SEQ ID NO: 3261 - DNA, 971 bp, Homo sapiens
  ENST00000484871
cccatgccactatgctatctctaattctgccatccagaccgagcaaacgtacttaagacctttgtgtaagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcagttgatattatggattcccataaggattcatgtcttctattcactttaatgaacagttgttgggcaacaattctagaagagttccaattctcatcaggagaatggacaaggtggagaagcagagaaaatgcaatgagtagaatgtctaagtcatcactttggaattgactgaacataaataaaaatgagaaagatacgtaaaaaagaagggaatggatgccacagcccccattttgccaacgaggcagctgaggttcccagaggctcaataccagcaccatgagccgcagcacgcaaggcaaacacagccggagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaact

SEQ ID NO: 3262 - DNA, 577 bp, Homo sapiens
  ENST00000485561
cccatgccactatgctatctctaattctgccatccagaccgagcaaacgtacttaagacctttgtgtaagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcaggacaatatcagaacggcacatacaagtgtccccaagtcatatttggaataagatcacttgggaacacaagtcaaagaaggacacagtgttctgcctctcctgagtaagcagcaacaacgcaccatcttggaatcaggggacggccctcaccagacaactaaatctgcagacaccttggacttcccagcctccagaactgattttaatgccttttgtaaagacctgcctaatggttctgccttcagtgcagacaatatggaagagtgtgacagatgttatcattgctccattgtgtacgagcgtaggacgatgcttctcttctgtcagcctgcaact

SEQ ID NO: 3263 - DNA, 857 bp, Homo sapiens
  ENST00000472470
cccatgccactatgctatctctaattctgccatccagaccgagcaaacgtacttaagacctttgtgtaagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcagacatatgaaggagggtcttttcatattaaattgttttcctggcagcacctgaaccaaaggatcagacttaaaataagtctttttccaatgttatgttgaaattggatacgacatttctcacaaaacttctaagtcaaacagtgatgagaaactactgcctaaaagttgatattatggattcccataaggattcatgtcttctattcactttaatgaacagttgttgggcaacaattctagaagagttccaattctcatcaggagaatggacaaggtggagaagcagagaaaatgcaatgagtagaatgtctaagtcatcactttggaattgactgaacataaataaaaatgagaaagatacgtaaaaaagaagggaatggatgccacagcccccattttgccaacgaggcagctgaggttcccagaggctcaataccagcaccatgagccgcagcacgcaaggcaaacacagccggaggattttaatgccttttgtaaagacctgcctaatggttctgccttcagtgcagacaatatggaagagtgtgacagatgttatcattgctccattgtgtacgagcgtaggacgatgcttctcttctgtcagcctgcaact

SEQ ID NO: 3264 - DNA, 1561 bp, Homo sapiens
  ENST00000498493
aagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcagggaccttttcaaagatattcagtagacagcctgtattttctgcatacgctatacccggccctcaagttacagacagcccaaactaaatgggatcttggaggtcagccaaagacagaggctctcttgaagaggactcctgggactccagaaatggaggagacattaaatgagaaagcacttcctcctctggatactgtgtaatctttatcaggaccacacaatgtgcctttatgtgtgatgatagtggacagatgtgatatttccaatggattctatcttgcttgcttatttatgtattgctcagacttcagcctttagtctgaaacaaaataagttagaacgttcattgcttctaatttataatgaggaactactgatcggctttctgagactgcatattaggtttcatgtcacagatgtttatatgaatgacatcatgtagtatatactcttttccttctggcttctttcactcagcataaatatttaagattcatctgtgttgcaacatatgaaggagggtcttttcatattaaattgttttcctggcagcacctgaaccaaaggatcagacttaaaataagtctttttccaatgttatgttgaaattggatacgacatttctcacaaaacttctaagtcaaacagtgatgagaaactactgcctaaaagttgatattatggattcccataaggattcatgtcttctattcactttaatgaacagttgttgggcaacaattctagaagagttccaattctcatcaggagaatggacaaggtggagaagcagagaaaatgcaatgagtagaatgtctaagtcatcactttggaattgactgaacataaataaaaatgagaaagatacgtaaaaaagaagggaatggatgccacagcccccattttgccaacgaggcagctgaggttcccagaggctcaataccagcaccatgagccgcagcacgcaaggcaaacacagccggagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttc

SEQ ID NO: 3265 - DNA, 995 bp, Homo sapiens
  ENST00000478226
agatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcaggacaatatcagaacggcacatacaagtgtccccaagtcatatttggaataagatcacttgggaacacaagtcaaagaaggacacagtgttctgcctctcctgagtaagcagcaacaacgcaccatcttggaatcaggggacggccctcaccagacaactaaatctgcagacaccttggacttcccagcctccagaactgtctttctggcaactgtctaaacataaaccagagaagggcaaggcagactcaggaaggacaaatagaaggctattttcataaatcggacatatgaaggagggtcttttcatattaaattgttttcctggcagcacctgaaccaaaggatcagacttaaaataagtctttttccaatgttatgttgaaattggatacgacatttctcacaaaacttctaagtcaaacagtgatgagaaactactgcctaaaagttgatattatggattcccataaggattcatgtcttctattcactttaatgaacagttgttgggcaacaattctagaagagttccaattctcatcaggagaatggacaaggtggagaagcagagaaaatgcaatgagtagaatgtctaagtcatcactttggaattgactgaacataaataaaaatgagaaagatacgtaaaaaagaagggaatggatgccacagcccccattttgccaacgaggcagctgaggttcccagaggctcaataccagcaccatgagccgcagcacgcaaggcaaacacagccggaggattttaatgccttttgtaaagacctgcctaatggttctgccttcagtgcagacaatat

SEQ ID NO: 3266 - DNA, 1861 bp, Homo sapiens
  ENST00000462876
agatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcaggacacagtgttctgcctctcctgagtaagcagcaacaacgcaccatcttggaatcaggggacggccctcaccagacaactaaatctgcagacaccttggacttcccagcctccagaactgtctttctggcaactgtctaaacataaaccagagaagggcaaggcagactcaggaaggacaaatagaaggctattttcataaatcggtgatcagaagaacatattccatttcctgagatgaaaaaatccttaggaagagaaagttttaaggaaaccaagagttccattatggacaaaaccaccaccacatgtgcagcatccctctgggtctcttccatgacaaccctgtgggaagccagcttggcaggtcaccttgttctagcagatagaaactgaatcaatatgggaagagccagaatttggacaaggttcaccaaacattcacactgatgccagaactggagtgcaggtcccagcttcccatactgtggagtggccatgcgttgtctggcccgtgaaatgtgagcagagggatctgtgtaacttacaggctcagcatgaaatatcacccatgtgacctccatatactttctcatgaaggtcagccaaagacagaggctctcttgaagaggactcctgggactccagaaatggaggagacattaaatgacatatgaaggagggtcttttcatattaaattgttttcctggcagcacctgaaccaaaggatcagacttaaaataagtctttttccaatgttatgttgaaattggatacgacatttctcacaaaacttctaagtcaaacagtgatgagaaactactgcctaaaagttgatattatggattcccataaggattcatgtcttctattcactttaatgaacagttgttgggcaacaattctagaagagttccaattctcatcaggagaatggacaaggtggagaagcagagaaaatgcaatgagtagaatgtctaagtcatcactttggaattgactgaacataaataaaaatgagaaagatacgtaaaaaagaagggaatggatgccacagcccccattttgccaacgaggcagctgaggttcccagaggctcaataccagcaccatgagccgcagcacgcaaggcaaacacagccggagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggccggcgtcaggaggaggaacgcgcatcagttcccaagcagtaggaagaactggaaggccttgaaaggcaatgcgcttcctttagaataacagtttgggcttggagtttcaacaggagaaagaatgattttaatgccttttgtaaagacctgcctaatggttctgccttcagtgcagacaatatggaagagtgtgacagatgttatcattgctccattgtgtacgagcgtaggacgatgcttctcttctgtcagcctgcaact

SEQ ID NO: 3267 - DNA, 466 bp, Homo sapiens
  ENST00000465451
tatacaggaggagatggaacaagatggccaaatagaagcctccagcaatcatctccccgaaaggaattgaacaactatcaaaacaaaattgaacaactatctaaacaaaaaagtaccttcataaaaaacaaaaatcaggacacagtgttctgcctctcctgagtaagcagcaacaacgcaccatcttggaatcaggggacggccctcaccagacaactaaatctgcagacaccttggacttcccagcctccagaactgtctttctggcaactgtctaaacataaaccagagaagggcaaggcagactcaggaaggacaaatagaaggctattttcataaatcggaccaccaccacatgtgcagcatccctctgggtctcttccatgacaaccctgtgggaagccaggcaagtgagaatcaatgtaaacatgaagttcatgctgcttactgtgtcgtgataatgtcc

SEQ ID NO: 3268 - DNA, 3301 bp, Homo sapiens
  ENST00000222693
ctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcgccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaatacgctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagccta

SEQ ID NO: 3269 - DNA, 776 bp, Homo sapiens
  ENST00000343213
accgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaaggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatat

SEQ ID NO: 3270 - DNA, 1179 bp, Homo sapiens
  ENST00000393480
cgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggtgagacggggcacaccgggtggaccggctttctgaaacatgggcatattctccgccacctgccccctactctcctcttatcccaggccggcgtcaggaggaggaacgcgcatcagttcccaagcagtaggaagaactggaaggccttgaaaggcaatgcgcttcctttagaataacagtttgggcttggagtttcaacaggagaaagaatgtcggtctttcctggggtgtgattttccttgcatacataaggctgggctgagtgtggaggcgggtacctggaagccacacttcttaccacaggctgctctcggggccctgttgtgactcgtacctgcggttctgggcaggactcttctttctttcattgccttttattcagtcactgcctgtgcttggggtaaaacaaaagtgatctctgagcagaatgccgctgacagtagaattggatgaggatgtcagacctggttaagcagtagtgtggaggggctgcttcaactttgcccctggcagatggcaaggatgggacccagaggaaagggaggtgtgtgcagttaaggcgagggtcccccccagtacaaacgaatgaaaactccagctgcgggataatgaatgagaaggcctccaaattactttttcactgatgaaacacaaatggaagtggcatataattaaaggggaaagaaatatggaagcccactgtatattgataggatattttgagtaactctattcatactcaaaatgtgtcctaaactgtagagaactttcttaagcatcttttaaattttttatggaaaatgtcatattttaccaataaatgttgttgtgttagaaaa

SEQ ID NO: 3271 - DNA, 787 bp, Homo sapiens
  ENST00000495841
ctgagacccgcacccttccccggtcccacccgtcaccaggccgcccgcgtagccaggaattcttagccaggttcctgtgcgcccaccgtgaccctaagagaagaggcggacgccctggcacgtccttccctcctgcttcccccgcccaaagcgctcccggttcccggggcgtcaggttggctgacagttcggggtccctgcgtcctgtctcctcagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgac

SEQ ID NO: 3272 - DNA, 4033 bp, Homo sapiens
  ENST00000327483
ggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgca

SEQ ID NO: 3273 - DNA, 4477 bp, Homo sapiens
  ENST00000268679
ccggaatggcccgagggaaggccgcgcagggcagggccccagatggttcctgtcagggaagtggcgggcgcagctgcaggcctccggccccggcattatcacggggacacagctggctgcctcacccgcaggctgcagggagaccttccccagcctgcagccccaggcccgccccgcgtcacatgagccccagggctcccaccccctccccagggcagaggacacccagttggtggccgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgca

SEQ ID NO: 3274 - DNA, 2380 bp, Homo sapiens
  ENST00000563856
actttgtaggaaaacacgggctggtctgccaggaagcctggagctcagagcgtctggtgggccagaggctcggagctgggaggccctgagggtctctgcttctccgcctcagcgacgaatgctgacacaggagaggcccaggacacacacggctcccagccgagtccaaggtccacagctccaatgccccccgtgcccgggcactgccctgggtgcctgagccagaccttgtccgagggcacctgggcctccccccagggacgcacacactcacgccctgcactcagggcccagccagggtggggagggccccagcgtgggaggggcagccgcgtggcccatcctgtgtgacgccggcccctgtttcagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcag

SEQ ID NO: 3275 - DNA, 1815 bp, Homo sapiens
  ENST00000563920
gttaaaggatggcaagtgcggtgaggataacagcagggtctggggtgacagcacagagccctggacgagggggcttcctgggctgcgtctgggtggggccagaggtgaaggcggaacggcagagttatccaagtgcttcaggtcagcagcagctcccccggctcgcgttaggaatgcagattccgggtgcgcccctggctgaccaggccctggggtgggcctcgcccttgccctgcaggggtgcagtgcctggggagccgctgcggtagagtgcaagctttgacttgtgacaccacgtgacccagctttgcacacacatgcctgggatgcctgtgtttatttgcatgcacttgtctgcacaggcatgagggccatcaacgtgtgtctgtgtgtgcacagatgctacgtgtgttcagctgcctacagccccatcaacatgtgcctttgtgtgcacagatggtacgtgtgttcagctgcacacagcccctgtccccaggttgtggccacgcgtaggaagtccagagacccatctgggatggcccatgtgaccgccagccctgcccatgtcctttgcagaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaagg

SEQ ID NO: 3276 - DNA, 284 bp, Homo sapiens
  ENST00000566868
cggtcccgaagggcctcagctaggaaaacacgggctggtctgccaggaagcctggagctcagagcgtctggtgggccagaggctcggagctgggaggccctgagggtctctgcttctccgcctcagcgacgaatgctgacacaggagaggcccaggacacacacggctcccagccgagtccaagacgtgcctcgcgagttcctgccgaggaccctcaccggctacgtgcctgaggacatctggaggaaggctgaagaggccgtgaatgaggtgaagcggcaggc

SEQ ID NO: 3277 - DNA, 1327 bp, Homo sapiens
  ENST00000569464
tctaaagctgcgaggcccgcggccgccgactgctgcgagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctaggaaaacacgggctggtctgccaggaagcctggagctc

SEQ ID NO: 3278 - DNA, 469 bp, Homo sapiens
  ENST00000569443
gttcagcctcccgcgcggccgccagaagccgcggttctaaagctgcgaggcccgcggccgccgactgctgcgagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtg

SEQ ID NO: 3279 - DNA, 539 bp, Homo sapiens
  ENST00000562719
caccagcgccttgagcgttttcctgccgtctccggacacagctggccctgggtggagcttctcagacttcagggagcctcagaccacgagggaatcttgttcagctgcagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccag

SEQ ID NO: 3280 - DNA, 664 bp, Homo sapiens
  ENST00000563640
cccgcaggctgcagggagaccttccccagcctgcagccccaggcccgccccgcgtcacatgagccccagggctcccaccccctccccagggcagaggacacccagttggtggccgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgt

SEQ ID NO: 3281 - DNA, 399 bp, Homo sapiens
  ENST00000564416
gcggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatg

SEQ ID NO: 3282 - DNA, 284 bp, Homo sapiens
  ENST00000570046
gcgggatcctgtgtccagctcttccactcgcccgtgttttctgggtccatccccactggagcgtgtgtcggacctgccttccttcttatgtctgaataagtgtgcactgcatctgcttttgagtttatctgtgctcggctgacagtctatggagaaccttgtctcaccacagctgtgtgtctcagccccagtggacaggaaagctaaggcctcagcgatgccggactccccagcggaggtgaagacgcagccccggtccacaccccccagcatgccgcccccac

SEQ ID NO: 3283 - DNA, 584 bp, Homo sapiens
  ENST00000561924
gtggcggcggcggcggcggcggcggccgggggcgattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggtgagagtttcacagctgctggcagtaactggcaagaagacaacaagaccctagtcctggttccaatttaggtggtggtgatgacctcaaacttcgttaattaatagcacagcagatgtgtgctgcccatctt

SEQ ID NO: 3284 - DNA, 3136 bp, Homo sapiens
  ENST00000290858
gcggtgagcgctggggctgcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggtgagagtttcacagctgctggcagtaactggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 3285 - DNA, 509 bp, Homo sapiens
  ENST00000564034
caacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgtatatttgaaggctcccatgattctgaatggagtctgtgttatctggaaaggctggattgatctccaaagactggatggtatgggctgtctggagtttgatgaggagcgagccc

SEQ ID NO: 3286 - DNA, 2971 bp, Homo sapiens
  ENST00000412916
agactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgttt

SEQ ID NO: 3287 - DNA, 846 bp, Homo sapiens
  ENST00000565389
taggaagctgagccgcgagtgtgagattaagtacacgggcttcagggaccggccccacgaggaacgccaggcacgcttccagaacgcctgccgcgacggccgctcggaaatcgcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagaca

SEQ ID NO: 3288 - DNA, 545 bp, Homo sapiens
  ENST00000563939
aaaatgcgaaaccagatgccgcgggccggtactcgcggggagacgcttttcctggggctcgccgcggtggcgcgtgtcggccaacggagcaccgcgagtggagctcgaacccgagccagactaaacaagcgaagggcattgtttaggcggcgacaccgaagaagggttcagggtatttgtagcaagcaaacccccattcggaaaaagaagtggagcttcattcaaggcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcggg

SEQ ID NO: 3289 - DNA, 610 bp, Homo sapiens
  ENST00000567947
cttaagcagccaatggcaaatgtcctcaaaatggaatcagatgtttgtaacttaatacttaagaaaaatgatgagtgcatgtttttttttacttttaagtattctctgtgctgcctggcttaagacataaactgatgtaaaaataaatgactgcttgcataatttatgtaatgtcctgctcctgatcctgtttgtattgatttttctaaaaggcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccaggtagggtaacatcaggctttattgagcatggtccctttagtccctaatcttgcctttgcctggggacctattttacccaatttttaagagtaagtatagaaagtattgtgttgaagcaatattgaggaatcctgaaaatgttgatactcaaattctgatcctga

SEQ ID NO: 3290 - DNA, 484 bp, Homo sapiens
  ENST00000566281
ctgagattacaggcgtgagccactgcgcccggccactgtttcaggaaaaaaaaaaaaaaaacaaaacccaaatattgtattttttttataaatcaaaattaaaataggtatttcatgtattctgacagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaat

SEQ ID NO: 3291 - DNA, 914 bp, Homo sapiens
  ENST00000568858
ctctcaatattaaaagaatggagatcaaccaggaaattttcttcattctggataccccctcctcgtggctgtttctgcatagctctgaccagtagggaaaactcaagctgctggtgtgtgttctttcgtctcatttggagtcatctcatgactgcctcctagcaactctatttgccttgttcctgggagatgatatactgagagaaaacaggagagcaactggtagtaagaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatcct

SEQ ID NO: 3292 - DNA, 4475 bp, Homo sapiens
  ENST00000394030
ggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 3293 - DNA, 6780 bp, Homo sapiens
  ENST00000264122
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 3294 - DNA, 4722 bp, Homo sapiens
  ENST00000476370
gttcaagtttgaaatatactgggctggggtattctcaaaaaagtgcaaccaggatgataaagtaaactagagtggattaaaggaactgagaattggctcagagaagagaagaccttggatgtagacgagagttgtcttcagttacagtatttgggaaagaaggattatattttttccatgtcacttcagaaggtaggagtaagatcaatgggaaatgttaagaatgaaaattgcattcatcctacaaagaagtttcctaaatcattacgaattgttctaccttgagtgtagtgagttatctgacactggaggatttaaaccaatggtagatcattacatagtagagatatgaacatgagctaaagcatgagggcagcaaagaggggagaactttgtttcacctaaatggctcttcaaaccttttttagcattagtttctgctttgatatactctattaaaatttgggggataattgataaatcttccaggtggtttatggatggccagggaggaaatttgccattgttttaattatttaattttatttgcctctgtttttacacttggtaaaaatttggaagtgtttcagatagtgaagaaaaaaaagaattaagaaaaacattccaggccaggtacaggctcatgcctgtaatcccagcactttgggaggctgaggcaggcatatttcttgagctcaggaatttgacaccagcctggccaacatggtgaaactccagctctacaaaaatacaaaaattagccgggtgttggtggctcgcgcctgtagtctcagctacttgggaggccaaggcaagagaatggcttgtgcccgggaggcagaggttgcagtgagtcaagattgaaccactccactccagcctgggtgacagaacaagacgctctctcaaaaaaaaaaaaaaaaaaatccatacttcctcctcctaatcattgataggtatccttcctttttttttgttgtttttttgtttagttttgttttgttttttgcctacgagtatgtaagttcacatttatgtaaaatttatttctcatagtatatgctatttataaccattttccagttaatatgtcatgagcaatgtatatagttgttaaatatttgtacacaatataatttttattgatgtatatttcctcatttcttttttaagtagcaaaccatttcctcccagtcttcccttagttttttataatctctcaaataagtactaaattttcagttttgcagtgctgtactataaatcacaggcagtagtactttgctttttacaacagattagtctctgtatgtgtatccatttatttctcaaacacttatataagtgataaattggctgtgatcatttcagtttgttttaatcctgtggatataatatttttctttagtttttgaagaatttattttagaaaagctttattactttacaaagttttcttatcaggggacaattggtaattattatactctgtgtagcaattgtgttatatctaatctctttccctttaaagcctgaatgcttccaactttataatttgctttagagagcccagtttaccctatggctgacaaatagcaaacttaggatatgatgcaagatagaacatgataatgattcaaaacagaaccataagcaggtatttttgctatttataataatattttgagtgtatctagtaccttttaaataatatagtttaatggaagaatatagtacagtggtatattttatagtctatgtatggctctgaagtgtatccagagtttactttttaaccttaaataaatagatgattagaaatagcattaagtgtatttgacaaacctataaatttcccgtaaagaaataagcaagtgtatgtattgtaaaagacagtctttcctctgacttaatgttgtatcaggggcatttagagtctacaagaacctaaagtaaattttatgaaatatctagtgcaaaatctttgggaaatttcaaaatttatgctgaaatcaccatatttgtttcctttggtttctctaacaaaccaaaagatcaacattgtctcatgcgatttatcttctcattccttcctaaaaatatttctggaaaattaatggagctggaccaccaattcttcaaatattgaaaactcaaaatctaagagttattttaatcttgaaattaatgaaaacaagttaaagagccttgtctaagtcaaaaagtcctcagcaaagctggtgataattattatactccaaaaaaggtgaaaagataatggcttcaaatcctgccttacattatccagtcaaaaactaatataaaaatagtcaatatttaagcctatgttttcatcgtaagtaatcaaatacttacatattattaatgtctaagggagtggaagttaaaacaatgaaattcaatcgggtcttctttaatatttacaatttttgctttacattagcaattcaggtttcactgattttaaaattgtgaacaatctgaatttgtgtggatttatttgtggtagttaaaagtaaatattaagtgcaagctatttgccaagagtgttctaggtgctatgtttgatttaggaggtataattcaaacatgagaagtaggaaaagatccctcagatccctgtcctcagaagaattgacggtactttcagagatatcgacaacataaaagtactatgagaggaaagcagcggtgcctgaggtgggagtgatagctagataaattattagtgaaccaaggttttcagatgtaatgtttgtctactcaaaaagggaatcaattctctaagaatttaaacccatataatactatgaatgttaaaccagttgggtttatggtattaatgatttaatacagcaacactgacaaaatctctttttctccctttagttccagttagtaaatatcatattttttactatttcagatgccccgtctctgactgccaaggtggtaaattatcacattttactgtatattcaaatgttaattactaaatggcataattttaacaattaaatttactattttgtgagccaactaacaacaatgatgttaagcataggatgcccaatataataataagcaccttgtatgtacagaagattttacatgcacaaattcatttaatccacacaaatccgaagtttcaggtctgttttacaaattttgtatgcccaatgcttagagagatcaagtaatttgataatactcttatagggaggatccaaacccatggttttatgtatatttgtttgtttgttttttgcttttactttagaacagtttctatacattgtacaggttggattgggacagaaaataaaatttagaagctgtttttattgtcaacaatcttataattaaatatatctgcaaaatataaatataaaacaagtagtctttattatctggaaataaatgtgaagagcatatttaagcaagtgatgaataaattagaaaatatgcaggcagtaaaaaatggttaatatcagtcatgaatttaattttctaatttatttttgaaagccataatcttcataaaataattctagaatttttttcttcagccaatcaacagagatcatccttttaatttgaaacttgtttttatttttaagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataa

SEQ ID NO: 3295 - DNA, 1493 bp, Homo sapiens
  ENST00000407712
caggttctattgaattcttccacagagataagttaattttacatagtgtttaggatatcaacaatttttgtggcccttgtaattcttggttatagtttaaaaaaagagagactgtgttacttgagatatttacttctacattttaaaataagggatgagtatcttgatgttattactggtaattttgagaaaagaaaaatatatgttcaaactttattaaataaacaggaatactagttccctctacctctcaagttacttttaattggaaagtattctccttatataattttactctgaactgtcctttaggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgc

SEQ ID NO: 3296 - DNA, 3350 bp, Homo sapiens
  ENST00000403724
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtacgtatagaatataatttcctttgtgatgtacatcttaatggtcagaatttaaaggcaaaatttcatgccattgtactgaaaatacattaaggttttgtgttatcctctaggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagcaccagttccacttacgctaattaaattatgcaaaattaaatagttgtatgtagagaactgataataaattctgttttattctaatcattacaactgtaacacattcaaaaaaa

SEQ ID NO: 3297 - DNA, 3237 bp, Homo sapiens
  ENST00000405772
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagcaccagttccacttacgctaattaaattatgcaaaattaaatagttgtatgtagagaactgataataaattctgttttattctaatcattacaactgtaacacattcaaaaaaa

SEQ ID NO: 3298 - DNA, 519 bp, Homo sapiens
  ENST00000438603
aagcgaagcaggaagtcccgcctttcagccccagatggctttggctcccggtcccgacgctcacgcccacctgccaccccttattgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacag

SEQ ID NO: 3299 - DNA, 944 bp, Homo sapiens
  ENST00000447441
aagcgaagcaggaagtcccgcctttcagccccagatggctttggctcccggtcccgacgctcacgcccacctgccaccccttattggttagctccttcgtgccttgcatcccttcgtccatttcctttcccgtttccactttcgttcccgggagagtccaggcccctcatttctctccgagtccaattcctttctgacgtgctgcgagcgggccttcctctggggccattgtgtactgtggaggacgtggacggggcggcagcgcgaggaggacgggcgcctcccgtccattggctgcacccgctgtcgggcagtgcgcggttgcgcggcattggctcagcggcgcccggccccgcccccgccccgccccgccccgagcctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacag

SEQ ID NO: 3300 - DNA, 561 bp, Homo sapiens
  ENST00000443752
gctgtcctgggtagaagggtttggcagccctagggagatgaatttctccagcgttggacccgcccagagcggagaagcaacacccttccagccactactctgttgctatgaaacaaaagactaggaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacag

SEQ ID NO: 3301 - DNA, 2435 bp, Homo sapiens
  ENST00000219197
cgctccggctgcagcgccggctgcatcaataattcagagcggcggcggcggcggcagcggcgggtgcgggcaggaggcggcggcagcagcgggaccgagcagcagcggctatgcatccaagtgcggctgggcagccgcggcacccctgaggcccgggaggggctccgggaacacagcgcggaggggacgctagtcgcggaggggacgctagtcccggagtgcgaggaagaggtgtagtgtccagagcggcggcggcggagctgcgcacggagctgaggagggggcttcggagcgggactgggacggggggggcggctggcgcgagcagccctgggggtggggggcggggtgggcgccggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtactagtgaacattgggaacaactttgattcagaacgcagcactttcatcgccccgcgcaaagggatctacagttttaacttccacgtggtaaaagtctacaacagacaaaccatacaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcacgacttgaaacttcctacatgttctctaactgtatctgggtaaaaaggtgcgcgccagctgtgggacaactttgtccatttccttattaggagaaataaatttcgcttagctctgcgcactcccatttccaaaaataaactcgcctcccccattccagttgcagtaatcaagaaagagactgccttgtcattgtttcttatcccccaacttcatgttccctgcaatttatttaaagaaactttgtatttcactacataatctgaaatctttctccctagccccctctgaatccttctgcctactgaaatctgatatattacacacccccaaccttttttttttcagtttggaaaggggtaaagttttgttgttgttgttgttttgttttggatggggaaggtagttttaatttggcaagtgttgctcttcttaaaacactgctcaaattaattagctgaagatacttagtatcctcggctgcttgttagcagagaaaggactcaccttagtggtgactggtttaaaaaatataaatatatatcatttgtatacgaagaactcttcccagtggaaactggctgtgtttccgtatttctatgttctattcggagtgatcgtgaaatctaaggctgcttgatgttctgatgcttgtcaatgccgtcgtgctctgtgactccacgaaacgccaaggagcttcttccggacgcctcctcttcctctgtaacatacgtgtgaatagtcaaggtttaattttgctttaatctaataaagtcgaagtgggacttttatttttctgaaacagctttctaaaatccgcatcttccccagctgcgaggttgggggtctggggtgccaaagggcgaggttccgaaaggcaggagacttgggggaacgcaaccatagaaaggcctgggcgcgagggcttccttgcaaagccggccttgcgctccttcctgcgccaggccggggaccagcactgcattcgcctgtgttcacagctttggcggaaacgtaagaaatgtggccgaaatcttgctaggccaggcgcggccgccggcccaggagcgaagtttgatttttttctttgcattccaaatgcatcaggaatagtcccagtttgaggacccaaacgaccctgcctggagcggcagactcctcaggccttctgtccccggatgtctcccaccgcgtccccctcgcagttcccgaagcagcgtatgttttatacaccgcctctgaatccggagtccacccgccgcatactcgggcgcccaggacctatgattccgctcattcacaggactttattcaagaggttcgtccaggagttttgattgtatcggaacataatgtgaaagcaaaaatgaaataaacgacttcgttttaagtctgaaa

SEQ ID NO: 3302 - DNA, 872 bp, Homo sapiens
  ENST00000564786
tgggcgccggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtgagtgttccttcctcccgcggcgtgcagattgggctggtgaaggagggatggatggaagaccgatgcccggtcctctccaagggctctgcggaggcgcggggacgacagtccgggaccgattcctgcccactccccttcgttcccgtctcgttataggtactagtgaacattgggaacaactttgattcagaacgcagcactttcatcgccccgcgcaaagggatctacagttttaacttccacgtggtaaaagtctacaacagacaaaccatacaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcacgacttgaaacttcctacatgtt

SEQ ID NO: 3303 - DNA, 718 bp, Homo sapiens
  ENST00000536749
gagctgaggagggggcttcggagcgggactgggacggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtactagtgaacattgggaacaactttgattcagaacgcagcactttcatcgccccgcgcaaagggatctacagttttaacttccacgtggtaaaagtctacaacagacaaaccatacaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcac

SEQ ID NO: 3304 - DNA, 2406 bp, Homo sapiens
  ENST00000585159
actcgcctcattttctctaagcagagcaacttcgcggacagcggagctcgcccagcatggatgttccaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagccgggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattgggaacctgtcaagaagtgctttatccagagaagcaaattttgcacgattggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgagtgagcgcacagtgatcaggtgcttcaaagccaacagaccagctcctcttcctccggatcctcttttgatctgcccaggaaagggatgcattgacactctcctgcatgcacctggcgagaagccacctgaaagtcactgtggttaaagatattggtggaggtaccccaggagcactgttacaaatccttcttgttttggcatctcgtacaacattattaagacacagctgagagttgatgggtgtgtaatgcatatgccaaggaaatgtcactaatcccaaagcaatcaaaaaggagacctcaaaccagatgttaatttgttctttgtgtaacaatgtaaccaaaatattgatgataaaagtcataatttaagattcagaataaatgggtttgatgtctggc

SEQ ID NO: 3305 - DNA, 2945 bp, Homo sapiens
  ENST00000269503
gtcttctgtcggagtccgccggtccgcagcctgcggcagggaggcccgggcacccgcaggtggcgccccacgtccgtgtttgcgccctcagccgagctccaggcgcagctgggaaacccagcgcgtctccccgggtcctttgagcgagcgcggacaccgcaatttaataaataagcgcaagcgccagccgctccaccagtccgaggtccagaggagcagacacacagacccgggccggaggcccctcttctagccctgcgggaaccggacagttccccaactgggactctggaaccacagctcctaaatcatcaaattctcaagctttttttttccctctcttcgtcccagccatcccagtcttcttcttcttttttttttttttaacttattgtttttttcgctcctgtcattatgaaagtggtcacgccattcaatattaagacttggagggaattggggaaagaaaagaaagaatctaaaagaagagaagcgaccggtgcttttaagggtgtctaattttcaaaagagacgtctgggagtattttgctctgggcgtttggagcaacttcgcggacagcggagctcgcccagcatggatgttccaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagccgggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattgggaacctgtcaagaagtgctttatccagagaagcaaattttgcacgattggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgagtgagcgcacagtgatcaggtgcttcaaagccaacagaccagctcctcttcctccggatcctcttttgatctgcccaggaaagggatgcattgacactctcctgcatgcacctggcgagaagccacctgaaagtcactgtggttaaagatattggtggaggtaccccaggagcactgttacaaatccttcttgttttggcatctcgtacaacattattaagacacagctgagagttgatgggtgtgtaatgcatatgccaaggaaatgtcactaatcccaaagcaatcaaaaaggagacctcaaaccagatgttaatttgttctttgtgtaacaatgtaaccaaaatattgatgataaaagtcataatttaagattcagaataaatgggtttgatgtctggc

SEQ ID NO: 3306 - DNA, 3336 bp, Homo sapiens
  ENST00000581425
tcatctacagcagggctaaattctacctgaatttatcagtttccagaatgtaaaattgaggtgaaggagttgaggtgaaaggaagaagcagctccagaggcttaaatggagaatgctttattcttttctaaaagctttgtaaggaagacagcgagcatagccttgtgagactgagaataggcatcccgaggtgtttgtcttaacaatggaacccagagtgtctgtctcagtcctgcccttgagtggagctgaagtggtgctcacagctgggttgaagaagctgaaacaggcatatttcacaagtcatttcggcgattgtcattggcagcatttcacattgcgctgggaactgcatgttattcatctataatgagtgtgtaagaaataacagcaaaggtattccagttgaagtttgtattcccattaggtaacaaaatcttaaacccaggattttgatgttgttgttggctgtttgttttaaaaggcaggccatcttattataaagcagttgtgcatttatggatgaggaggatggagacagcatccagacaaagtggccagagtctgtgttgagcatctgaaagaaattgggtcatcacgggggtcccgccactcttgaaattctgcttatgaaacactcacccctgcccttttatctgaggaaagccatctgcagggtcatgcgcacattccaggtggctaattttgtcattgttttgcatgttgtagagttcccattagcttaagctaaggatgtccaagctgccggttctctatttattcaagctcatttacagggcaccatggctcaggcaagggagcagcacattgctcagggaaaattaaggaaaaacaggagtagcaaatgtttttctacaaaggtctttcattcaccacccatcatcaaccacctactgtgtgagtccagagtgtgccaggaactgagaaacactggagatccaaacctcacagagaccattgtctctgggagcacgtgaagttaggtcccaagcttgaacttacagaagtgatctcctttaattggcctcttgccccatagccgcttctctacccattcagaatggaacttttttgtttgtttgtttgtttgtttgttcgtttttttgtcaaacaaggcatcatgctgatgcccccatattcccacagacctccctggactcaatttaggatttgtttaacaagcttaccatcttcgattcctttctctctgccctgcccctcaacttacaaaattcacagccagtttttgaatgcataattaaaatatgctttagaaatcttgattagttacaatttattaaaatacctttgagattacttcctgctataggatcttttaacttcagcactgcctccttcctggggaagccagaatgctgaggatgctgaatttgtgttcccagccgctgatgaaggaggcagtgttgctggttatccaaggatgatgaaaacatacaccgaggaggggcttgccattgtgtgctgtgttccctcttctttttcaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattgggaacctgtcaagaagtgctttatccagagaagcaaattttgcacgattggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgagtgagcgcacagtgatcaggtgcttcaaagccaacagaccagctcctcttcctccggatcctcttttgatctgcccaggaaagggatgcattgacactctcctgcatgcacctggcgagaagccacctgaaagtcactgtggttaaagatattggtggaggtaccccaggagcactgttacaaatccttcttgttttggcatctcgtacaacattattaagacacagctgagagttgatgggtgtgtaatgcatatgccaaggaaatgtcactaatcccaaagcaatcaaaaaggagacctcaaaccagatgttaatttgttctttgtgtaacaatgtaaccaaaatattgatgataaaagtcataatttaagattcagaataaatgggtttgatgtc

SEQ ID NO: 3307 - DNA, 543 bp, Homo sapiens
  ENST00000584764
actcgcctcattttctctaagcagagcaacttcgcggacagcggagctcgcccagcatggatgttccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttt

SEQ ID NO: 3308 - DNA, 631 bp, Homo sapiens
  ENST00000583651
gaaatggcctgtctgctttcctgggaggagcggggacggggcaaaagtgcagacgggcgcgtaagttcgcagaaacctgcaggggctgccgccccgctgagaaagagagaatccccgtggtctggaaaccagagctggagaataacccaagcctgggattccgtcgttggaatcggtccttcgcctaagagaggaatcccaggggtttcacccaagggggctcgctagtggctgcagggaccttggaagtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacac

SEQ ID NO: 3309 - DNA, 537 bp, Homo sapiens
  ENST00000581073
ataagcataaatgttctaagagtgtacaacaggactttgcgtccgtcagtgaggataacaagtctgtcattggatagatcctaagtgaaattagatataaaagagaaatgaattgaatttactggacaacattcttcagatctgctgggacatattttcattttctgtgagtactggaatggattgggacaaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtggggg

SEQ ID NO: 3310 - DNA, 326 bp, Homo sapiens
  ENST00000580889
tctgtcattggatagatcctaagtgaaattagatataaaagagaaatgaattgaatttactggacaacattcttcagatctgctgggacatattttcattttcttgagcatctcaacatcttttgtgaaaaaggagaacgtggatgtcactggctttcacttcatgttttaggtcagcgctgcttttggggtgaaagaagaccatcagcaaacctcagccttgcggccaggactcccccgtcttctgtcggagtccgccggtccgcagcctgcggcagggaggcccgggcacccgcaggtggcgccccacgtccgtgtttgcgccc

SEQ ID NO: 3311 - DNA, 576 bp, Homo sapiens
  ENST00000583570
agtcataagcataaatgttctaagagtgtacaacaggactttgcgtccgtcagtgaggataacaagtctgtcattggatagatcctaagtgaaattagatataaaagagaaatgaattgaatttactggacaacattcttcagatctgctgggacatattttcattttctgtgagtactggaatggattgggacaagcccactctgcccctcatcctgtgcctatgaagaccccagactcagtcagagagaaagggagaagcagctggacttctgaaagaagaaacttgacttcagagggaagacttgatggcttgatttcaaagaagagtcctgccagagatggccagacttgaggggaagattacctgcccatcccatttcctttccagctccccttcctgctgagagccactttttcatcgttcaatgaaattgtctacattcaccatccttcaatttgttcctgctacctcatttttcctggatgacagacaagagctcgggagccacaagtgcagatactcaaaaaaaaaggctgtcacactggccctttgccctcagtagtggaaggcag

SEQ ID NO: 3312 - DNA, 262 bp, Homo sapiens
  ENST00000582667
gtcctccacagcaaagtgtattccacccattttcttagagagagagaggcaagcatcctattattagacagattctcaatgtgcctctcacccctctgacattcagactcctggctgttattttccagaagattttgagcccactctgcccctcatcctgtgcctatgaagaccccagactcagtcagagagaaagggagaagcagctggacttctgaaagaagaaacttgacttcagagggaagacttgatggcttgattt

SEQ ID NO: 3313 - DNA, 2346 bp, Homo sapiens
  ENST00000267406
gggctgttgatttgtgggggattttgaagagaggaagagtaggaggaaggggttgaggggctgcctctggcatatgcacacactcacacattctgtcacacccgtcacacacacataccatgttctccatccccccaggtccagccctcagtgctgtcccatccagcagggctgccctgaagctctggctgcagccctcccgtccagtgggcaggcggcttcatccctcctttctctcccaaagcccaactgctgtcactgcatgctctgccaaggaggagggaactgcagtgacagcaggagtaagagtgggaggcaggacagagctgggacacaggtatggagagggggttcagcgagcctagagagggcagacgatcagggtgccggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggggccgggtgggcccaggaggggtcagagcccgtcctgctggagggggagtgcctggtggtctgtgagcctggccgagctgctgcaggggggcccgggggagcagccctgggagaggcaccccctgggcgagtggcatttgctgcggtccgaagccaccaccatgagccagcaggggaaaccggcaatggcaccagtggggccatctacttcgaccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtctttcaagcacaagaatccagcccctgacaactttcttctgccctctcttgccccagaaacagcagaggcaggagagagactccctctggctcctatcccacctctttgcatgggaccctgtgccaaacacccaagtttaagagaagagtagagctgtggcatctccagaccaggcctttccacccacccacccccagttaccctcccagccacctgctgcatctgttcctgcctgcagccctaggatcagggcaaggtttggcaagaaggaagatctgcactactttgcggcctctgctcctccggttcccccaccccagcttcctgctcaatgctgatcagggacaggtggcgcaggtgagcctgacaggcccccacaggagcccagatggacaagcctcagcgtaccctgcaggcttcttcctgtgaggaaagccagcatcacggatctcagccagcaccgtcagaagctgaaccagcaccgtatgggctagggtgggaggctcagccacaggcagaagggtgggaagggcctggagtctgtggctggtgaggaaggaaggagggtgtattgtctagactgaacatggtacacattctgcatgtatagcagagcagccagcaggtagcaatcctggctgtccttctatgctggatcccagatggactctggcccttacctccccacctgagattagggtgagtgtgtttgctctggctgagagcagagctgagagcaggtatacagagctggaagtggaccatggaaaacatcgataaccatgcatcctcttgcttggccacctcctgaaactgctccacctttgaagtttgaactttagtccctccacactctgactgctgcctccttcctcccagctctctcactgagttatcttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatggtggtcagtgagacactatagaattactaaggagaagatgcctctggagtttggatcgggtgttacaggtacaagtaggtatgttgcagaggaaaataaatatcaaactgtatactaaaattacattttaaaa

SEQ ID NO: 3314 - DNA, 718 bp, Homo sapiens
  ENST00000555436
gatgggggagagaaggcgttcaccttggctctgctggcgttttccttggggccctccagctgcagccagatgtgggggttgtccggacagtccttcggaaggacgctcacccccacgctgaagatgcgctccacatggggctgctgttcccgaaccttgttctcagcctccgcagacaccgcaaagcgatctggggacgcggggcgggccccccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtctttcaagcacaagaatccagcccctgacaactttcttctgccctctcttgccccagaaacagcagaggcaggagagagactccctctggctcctatcccacctctttgcatgggaccctgtgccaaacacccaagtttaagagaagagtagagctgtggcatctccagaccag

SEQ ID NO: 3315 - DNA, 2656 bp, Homo sapiens
  ENST00000461686
gggatcagaaaactcgctggttaatgagtggccaagaacatatcagcttaagtttgggaaaaacacacaacagggcattgtgtcagagggtgaccaaagtgactccccagcagatggaccagggaacgaacaggtgacctttgaactgaggccggagtggaagcagcgagggtgtgaagggccgggtgagggtcaaaggcagaagcaagcaggtggggagggttagcgtcatgcctgctaaggagcagtggacgggtcctagcacgtgctgtgagccacccgctgtccagggagcggttacctctgtcttgccagcttcgtggggacagatagttcagctcatcatttatgagacagagaatgggaatttggagggtctgtggctggcctcgtcctgggtgcgcagggggtcacctgaggtgtggtctgaggcctccggggaagggcatttctttgcaggacgcagtttccaggctcaagaacgtggagggaattcctaagggtcgctcttcaccaagagcgcagagccctggtagacctcagcatcgtcacagagaaagctgtgggtgcagaggccttggggacaaggcggggacggaatttcgtatttcagatgaccaaggccaatggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 3316 - DNA, 2453 bp, Homo sapiens
  ENST00000398158
ccgtctccgcctcgccgcagtcggggcagccgctcgcccctcttttccatgtatccgtccagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 3317 - DNA, 2605 bp, Homo sapiens
  ENST00000398165
gtgctctgccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 3318 - DNA, 2353 bp, Homo sapiens
  ENST00000359624
cacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 3319 - DNA, 2583 bp, Homo sapiens
  ENST00000352178
tcccgggcccgcgacacacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 3320 - DNA, 573 bp, Homo sapiens
  ENST00000451248
gggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacac

SEQ ID NO: 3321 - DNA, 1038 bp, Homo sapiens
  ENST00000462349
ggcctggctggtgggtgcccccagttgggttccccagtgtggggtgattcacatctggtgcccagggtcaagatgccctgtgcagggctcctgcccacccccgtcagtgcaagaacaccatctccccacatacttggccagcctgccatgtgtacctgtgcgtgtgagtgtgtgaggggcagagagcgagcatgagaggacgtgtttatctgagtgcctgagcgatggctgtgtgcatgctcacacacgcttgttggccatgggggcgggaagtccagcccccaggcttccccctggggcttccagccagcacttgggggtctctgctgcaccagtgaggtccaggagaggggctgggcaggcagtgcgtgccactcagcaggggcgggggcccggtggggccctgcggggactcggtgactcccccatcccgcaggaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggt

SEQ ID NO: 3322 - DNA, 1515 bp, Homo sapiens
  ENST00000491776
gtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcaggtaggtatcacccacccctcagaatggctctcaggctcagattcacagcctccccatggcaaatggaggccttccagggtcctggacccacccccaagcttgggtaggagggatccccctcttaatctcacatttacttgtgtttgaacatctcagaaaaaaaaaaagatgcaaattccaatgtcagggtccccaaatcaagtcttcctggagcatgtccacgcttgtcaccaccgtctgtggctgctttcaagcacgtcagggctgcgtgctcataacagagacggcacggcccccaagacctaaaataccaccagctggcccttgtcggaaagtcccctggctggccctagtccattgactctgggccgagctgccagggccacagaagcctgcggcactcagggctcccagggctcccttctccaacagttgctgtgcctccgtttccccaaaatgcaaggagctgatctcatctgtgttccctatcttttcctggggctctaagtgggccaccccaagggacctctgcctacaaagagaggagtgacagccgtggcggagttgggacgggctccgagggctcttcctcacccgcaccttgctcacccctctgtgcctcatgacagctggtgtagggtcctgtggagacgcaggaccaagaggatgtgtggggagcggggagagagagggaacgagatctgtgttaaggaactggatcatgagatcacggaggctgacaaaccctgagatctgcagggtgaggcggcaggccggagactggagagccagcagttcaagccccaaggcaggaaattccacctttggttctattcaggccttcaactgcttgggtgaggccctccacagtagcacacgttatctgcctcttgactcttgtgctaatccggaatcccctcacacatgcccagaacgacgtgtgaccaatgcctgggctcccacggccccgttaatctgtattaaaa

SEQ ID NO: 3323 - DNA, 676 bp, Homo sapiens
  ENST00000458223
gtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagaaaaaaaaaaagatgcaaattccaatgtcagggtccccaaatcaagtcttcctggagcatgtccacgcttgtcaccaccgtctgtggctgctttcaagcacgtcagggctgcgtgctcataacagagacggcacggcccccaagacctaaaataccaccagctggcccttgtcggaaagtcccctggctggccctagtccattgactctgggccgagctgccagggccacagaagcctgcggcactcagggctcccagggctcccttctccaacagttgctgtgcctccgtttccccaaaatgcaaggagctgatctca

SEQ ID NO: 3324 - DNA, 828 bp, Homo sapiens
  ENST00000430013
gtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagggtccccaaatcaagtcttcctggagcatgtccacgcttgtcaccaccgtctgtggctgctttcaagcacgtcagggctgcgtgctcataacagagacggcacggcccccaagacctaaaataccaccagctggcccttgtcggaaagtcccctggctggccctagtccattgactctgggccgagctgccagggccacagaagcctgcggcactcagggctcccagggctcccttctccaacagttgctgtgcctccgtttccccaaaatgc

SEQ ID NO: 3325 - DNA, 673 bp, Homo sapiens
  ENST00000496485
gttttaggggtcgagtgtcactgagcaaagactgggctggggtgccccaggctgcctgtttctgaggctttcacagaccaagggcagcaacgagggctgctccaactggagaagaagtttttcttttgaactttttggttacccaccgtggtttgggctgagtgtgttttcaatgattattactatgagtgatgggctggccaggcagggacccaagaatgttatccgtccaccagggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatg

SEQ ID NO: 3326 - DNA, 773 bp, Homo sapiens
  ENST00000486098
tcttgggtttctcatcctgcctctgaggctgggaacaggccaccacccacaggcagatcattaacaggcagttgttaacggcggtattggccactcccataatagaatatcgaggcatgtccaggcggggcttttgctggccttgagccctgaagccgcgccctctgcagatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtgagtgggtggcgggcacgggggtatggggaaggcagagatggctagggggcactggggatggctgggggcgcaccctcagtcagccaccgacctgcatgtgtaagacagcagttctgaggagtgtcactgcggcggccacgagcctcaggtgttgtctgcctgcccagtgtggtcacctgctcaggtgagggcaggaggccatggggcggggcttcgagctgccttccagaatgtgtttctagaacaaggctgaagctctcatggcacttattgtttctaatcaagtccaccagggcccctggggcggtggctctgcattgacggggcccatggccgggactgggtgctgcgagcaccctggagcagctggggaggggactggagcctga

SEQ ID NO: 3327 - DNA, 819 bp, Homo sapiens
  ENST00000441030
agttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaag

SEQ ID NO: 3328 - DNA, 894 bp, Homo sapiens
  ENST00000470912
gtgctctgccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctctggcatttctttgcaggacgcagtttccaggctcaagaacgtggagggaattcctaagggtcgctcttcaccaagagcgcagagccctggtagacctcagcatcgtcacagagaaagctgtgggtgcagaggccttggggacaaggcggggacggaatttcgtatttcagatgaccaaggccaatggccaagtgtgagttcttcaacgcgggcgggagcgtgaaggaccgcatcagcctgcggatgattgaggatgctgagcgcgacgggacgctgaagcccggggacacgattatcgagccgacatccgggaacaccg

SEQ ID NO: 3329 - DNA, 683 bp, Homo sapiens
  ENST00000465732
gtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctctgtgagtgccctggctttggagaggggcttcctccatctacactgggctccgtgggcctggggggtcctggggggtcctgggatggatcccttaggcaaggccctgggatcagaaaactcgctggttaatgagtggccaagaacatatcagcttaagtttgggaaaaacacacaacagggcattgtgtc

SEQ ID NO: 3330 - DNA, 672 bp, Homo sapiens
  ENST00000488526
cggcctcccaaagtgctgggattacaggcgtgagccaccgcgcccggcctatttgttacaattaatgagccaattccacgatcacataaccattgttgacattaaccaaagtccgcgcttgagtcagatttgcagagttttctcctcactgcccttttctattccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctctgtgagtgccctggctttggagaggggcttcctccatctacactgggctccgtgggcctggggggtcctggggggtcctgggatggatcccttaggcaaggccctg

SEQ ID NO: 3331 - DNA, 727 bp, Homo sapiens
  ENST00000478709
taaaggttccttaaattcccgaagggcaagaagttaaccaagtaaaacagcatcggaacaccaggtgagatccggccccaccgagactcgctcccctctctggacagaggatctcaactgggtcccggtttccctctccgcgcctccgcccagagttgcatcatctgcaccgaaaggcggcgagacagggtctcccaagacccccgccccaccggcgcccacgcctgcggtcttgaccgcccagaagatgggggctggccgtgcacgtggccccgggctcccaccccagcccccgcgccggcggagtggaccccactggcggcgagtcctggagcgtggagcagggacgcggggtgggaatccgggggagatgcacgtttcggtgcccagcattgagttcgctgcattgtggatgggaaatggctgtttgcaaatcgccctttttggcggaccgtgtggggtggcggtaaacgctgtcgttgcgcgggcggcacgcgaggtgggtgcccgctgggggagggacgcggggctctgcccaggttgcgttcgggggatggaggttttcctgggacctcacttccctgagccccaggcgagaccgcagctgagctgtaggatgcaagcgggaggcggagcgtgggtgggagagcggagcgcgaaattctcggcttcccgaggatcttctgggcttacttgtccccagctttgtcccaaagtgtcgcttccg

SEQ ID NO: 3332 - DNA, 1554 bp, Homo sapiens
  ENST00000382436
cacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataa

SEQ ID NO: 3333 - DNA, 2996 bp, Homo sapiens
  ENST00000611553
tccccctcccgtcctgtccccatcagtgttgaaatgtatgctacagttattatggttgtaatttgttatgccatgttgatcttcttgtgcttttcatatcagaacaatgtatttttaacattctgactttctttttctctcaattggtaactgactatatagaaaatttatatttatggatactatttcttttttaataagttcaagggaaaacattgataaaggaaaatttatcctttcaactttctttaggtgccagcattattttcatattaggaagcaggagaaagttaaggaactctaaacaatactagaatggttatatatatatttaagtttgtattaaacctgttggaatggtaaagaaatttactgacatatttaaccatacaaaatagtgttgctaaaagactagtttttctctttattctgtgcatatgtatatatatgaatgtgtgtttttttttaagaaattttaaaaaaacttaatctgccagcttttctctattggaatttgcgaacaacttgtaaaattggaattacagaatattagaatagtcagttatggaaagtcacttcattatccttgtgtcactaaataacgtataaagttaaatcagaagtgtattcatctctgaatttctaatcagttgtttttagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgttgtactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtgcacaaagtttttggtaaattaagaatattatttcaaataaattaatttcatccccataggagccagtttatcagataattcgtttctcatttctgcaaatcaatacacaatgagctcatattcagataaattgagctcatatccagataaatataatagtttttctttatttcaacattgttcattgattgcaacccatttctaaaacaaattatttaatataaccaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaaatcaatacacagaaaccttttttgaaaattaaaaacattaagaaacttcttgtaattcacaaataattggaattaagtaattttctcagcttaagagtttgtattttttaagtgaatatcagtaattaatccattaacattgatgctctatttctgcttttaagtttgaactgaggctgattaatgttcagtcaattctcctttgagcagggattggtgtcaatcaaagacaaatcacaacaagtgattgtccagggtgtccatgagctctgtgatctggaggagactccagtgagctggaaggatgacactgagagaacaaatcgattggtcctcattggtaagtctcaaaggattcacagttttgaaacaaagtgaaaaatatatttgaaagggatatcatgtgccacttaaacagattaaccattcaggtcctcttttaaaactaaataagcttgtggtcaatgtttcatctttgtcacgttacaatgttcgtaaaagcttgttaggacttttgttcttcttcaattttagaaaagtggttaatccaaggaccaatgtgactttgatgtactgacctggaaagttaaagatggaatcactcaattactattctttttgtaaatttttaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaa

SEQ ID NO: 3334 - DNA, 1813 bp, Homo sapiens
  ENST00000494538
gtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccacccactgacccgttcccaatctgagcatatggatagggcccaaagcagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactagatccataaatggactaggacaaatcttagaaacacaaagatcaaggctcagcagctgatagactcagcaacaggcagccaggagctctgaggctcacagctggcagtctagttccactcagtctctacttgagaaattctttctttggaagtacagcagaggccttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaa

SEQ ID NO: 3335 - DNA, 3334 bp, Homo sapiens
  ENST00000617917
ttttaaaatgctggtaatggtcttttttttccttttttttttttttcttggcgattttaatgctttggaaaagatctcatggttttatctccaaaggaggaaattaatttgatgccatggaaattagttttctagtcgtatgccttgaatgagtgaagaatttctttttcatggtggtactaaatttggggaaagctatagaaactttcatctggaagcttacacttttcctcttttttgaaaatttggtgagagacttggatattttattattttctgtaaaagagtgtaatttgttatacaggtctaatattgatccttttttggaagtatggaaagaatctgagtataaagcagaattacctctggatggcatgtattctcaaggacactgtcacagtgaaacagtttatttagaagcttgtgtttccaaactgttgaatttgatattcacaaaattggcatgtgtaaactttattaaactttaagctatttcctaagatgaagatgacaaacttggagggaaacttcattcatttggtttatttttatttttatttttatttatttttatctttttgagacagaatctcactctggtttgagacagaatctcactctgtcccccaagttggagtgcggtggtgcgatctcggctcactgaaacctctgcctcctgggttcaagcgattctcctgcttcaccctcccgagtagctgggattacaggtgtgcaccaccacacccagctaatttttgtatttttagtagagacggtttcgccacattggccaggttggtgtcaaactcctggcctcaaagtgatccgcccaccttggcctcccaaagtggagcccccgtgccccttgtttgtgacctgtcaatataaatatgctcagtagcggggggaggggtggggggtgaaaaaggaaatatgtttaatattaagactttggccttttagtgtaaactgatattcaaaaatttcttcatagaacatttgcttctttgcttgatcatttttctaattctgtacatctaaaatgcccagaatttgagttgctgttatagtctactaacatagaactttggagtaataagatgggaatttgtctctcttttgccaagacaagcattcgtaatctaacacagtattgttgccacgagtacgagtatgtgatagactgttgagaataaagaaagcaggcacagttggtcagtcctaagataaaggagatgttttttcttatatgtttgtgcattaaagaaaaaaaaatcttgaatctgaccaatgatgttttttttccttgtaagaaaatttaacaaatgtttggcaagcttctggaatctaaatttgaaattatacatttgtcattttctttaaatatttcttcaccttagctttgattatgagaaatcactgtcctctgctgttctttttttttttttttcttttgaggcggagtctcactctgtgccaggctggagtgcagtggtgcaatctcggctcactgcaacctccacttcctaggttcaaatgattctcctgctgcagcctcccgagtagctgggactacaggtgcgtgccaccacacccagctaatttttgtatttttggtagagacagggtttcaccacgttgtccatggccaggatggtcttgatcttgaccttgtgatccacccgcctcggcctcccaaagtgctgggattgcaggcgtgagccaccgcgcccagcctgtcctctgtgattttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaagtaattctaagagaaataatgtctattcggatggtgggaattttctttctacatgcagccccattctgaatgaatgaaatcaaatcacgtgaagatcagggtcctagagtaacttaatattttgtacattggttatttgactcctcatttttatattacatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcagcattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacac

SEQ ID NO: 3336 - DNA, 2561 bp, Homo sapiens
  ENST00000613125
agtactgttgcttctccattcccgagttagtccatctcctgattgaatttcattgtcaggcagtcttttcaagttacaggtactgcatgcattctttgggttcttatacacttcattgattcaaaatatttgtcttttgtttttatattacttgaaggattacttggctaggtataaaatttatcagtcacacttttttccccctcaactttgtaaatgttgttccataatctcctagtgtttgattggctggatttctttgtccaatgttttctccttttattaggaagaatttgtgagtattatagtctctgagtttcaatgcttgctgttttctttaatgcttgagaatgtctgtctattgctttcgttcctgaaaaataacttgtttgggaacactttcattagaactttgtggtcactgttttattattttgggacatctagtgttactgtagaaaagtctgatttttctccctccctccttgaaggcacttttttttttttaatctaaaatgcctgagagttttcttctttatttttgaaattcagtaatataaacaaggtatatctaagtgtcacttataatcatttttccctaaattataatatgcccttagttcttctaagaacattttccttgtttattaccatgaatacttttttttggtcaaattattagatcctctacttcatgacaccagtttttttaatactgaattttcttttgttcttcgtatgtattctaattgctttgatttgtcttttacctttgcatttactgtgatcatctgaagcctttctttttgtcaataattctgttttctccagtatctgtcctgtttttgatattttaaatgaattaattggttaagtcattgtgttatataggctctaagtttctttagcactacaaactgcattttcatcttattctgcttcttgcttttgagcttgtttattataaggttgtattgttttcaagttcttcattatgatgaagttgttgagaattttctttagtttttattgggttatgtatccttccagaatgggttctttgccacttgtatgccctattcatttcttcattttgtgttctttcttgctttttattccctgtatgtgtgtatttctttttgtcaggctgtaatacatatgcatacatgtttcttcttgatatgggagaacttctatgtggtgctgatgggaaatatttttaatactccactctccttacccaagtttgtttttctcctgagccctagtttgaaagctgtatattgttggagtggagggaaggagaagggaaaagtggtgattcagagagccaaatggggcaatgtggcttttaggctctgctctcttgaagtaccaagtatttcactcttgggtctgcccaactgcttatgaataaaattcctttgccttgtatggggacatcattcgacctcagacctctcatttctctttgttctgagccctagaatgtgacctgaccttctccttcccaaagcatggagatggttaaaactcactcttgaaatttttttgttgacttttccctctgttgcttattcattcctcggctctactttttgccattttggagtgtatttctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaaggctcagcagctgatagactcagcaacaggcagccaggagctctgaggctcacagctggcagtctagttccactcagtctctacttgagaaattctttctttggaagtacagcagaggccttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggta

SEQ ID NO: 3337 - DNA, 1877 bp, Homo sapiens
  ENST00000610358
gttgagaattttctttagtttttattgggttatgtatccttccagaatgggttctttgccacttgtatgccctattcatttcttcattttgtgttctttcttgctttttattccctgtatgtgtgtatttctttttgtcaggctgtaatacatatgcatacatgtttcttcttgatatgggagaacttctatgtggtgctgatgggaaatatttttaatactccactctccttacccaagtttgtttttctcctgagccctagtttgaaagctgtatattgttggagtggagggaaggagaagggaaaagtggtgattcagagagccaaatggggcaatgtggcttttaggctctgctctcttgaagtaccaagtatttcactcttgggtctgcccaactgcttatgaataaaattcctttgccttgtatggggacatcattcgacctcagacctctcatttctctttgttctgagccctagaatgtgacctgaccttctccttcccaaagcatggagatggttaaaactcactcttgaaatttttttgttgacttttccctctgttgcttattcattcctcggctctactttttgccattttggagtgtatttctggtgcagtggcttctatgttttgggttgatgccgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagaacaataaacatgcagtgattgatttttcttacttcaagtggatgagtgagcaagtgactaaaatcttctgtgaattcttcagtgtatggtgcttgccaatgcatctgagaatctagggactttctgaaatagtacttccttgctatgaggactgaagttggattagaatccttttcaatgaagatcagatgtcctgagtagaattcttactattggagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggt

SEQ ID NO: 3338 - DNA, 720 bp, Homo sapiens
  ENST00000622791
agaatgaattaaataatgaggaccctttcatcagggtttttgagtgagttttttaaaatacaaggtagtagtttgtgtaaatactaaatccattggtacctgtgcagaatgtaggaaatggagttgctaattccaaaaaaacagcacatatgctgaggaaagtataatacctaatatatatggtttaagcaatgtaaaattccatgaatatgttcctttcatcttaaaatttgtgatttaaaaaacattgatatcactataaagaattattattatttcccttgatttacagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactggg

SEQ ID NO: 3339 - DNA, 2433 bp, Homo sapiens
  ENST00000486387
ggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagaacaataaacatgcagtgattgatttttcttacttcaagtggatgagtgagcaagtgactaaaatcttctgtgaattcttcagtgtatggtgcttgccaatgcatctgagaatctagggactttctgaaatagtacttccttgctatgaggactgaagttggattagaatccttttcaatgaagatcagatgtcctgagtagaattcttactattgggtcctgaatcttatattaaatattctctcaaattccttgaggcgtgagccaccgcgcccagcctgtcctctgtgattttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaagtaattctaagagaaataatgtctattcggatggtgggaattttctttctacatgcagccccattctgaatgaatgaaatcaaatcacgtgaagatcagggtcctagagtaacttaatattttgtacattggttatttgactcctcatttttatattacatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcagcattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactggg

SEQ ID NO: 3340 - DNA, 1979 bp, Homo sapiens
  ENST00000617722
ttgattttacaggcccataggtggaagggacttgccttgtctcagatgagactttggacttcggactgtggacttttgagttaacactgaaatgaattaatgctgaaatgaattaagactttgggagacggttgagaagccatgactcattttaaaatgtgagacatgcctttcaccttctgccatgattgtgaggcctctccagccatgtggaactgtgaacacacattgttcatcccctcaggaggacacagcttttgagataccatcttggaagcagagaccagccctcactagacacaaacttcctggcaccttgattttggacttcatagcctctagaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaaggctcagcagctgatagactcagcaacaggcagccaggagctctgaggctcacagctggcagtctagttccactcagtctctacttgagaaattctttctttggaagtacagcagaggccttagccactcatctgctggcagaggtagcagaagaatgcccttagtaacaataaacatgcagtgattgatttttcttacttcaagtggatgagtgagcaagtgactaaaatcttctgtgaattcttcagtaatctcactctggtttgagacagaatctcactctgtcccccaagttggagtgcggtggtgcgatctcggctcactgaaacctctgcctcctgggttcaagcgattctcctgcttcaccctcccgagtagctgggattacaggtgtgcaccaccacacccagctaatttttgtatttttagtagagacggtttcgccacattggccagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgg

SEQ ID NO: 3341 - DNA, 449 bp, Homo sapiens
  ENST00000457288
ggaagaagtaaggaaaagagcaatatggatgtttaaaaatgagaagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattgg

SEQ ID NO: 3342 - DNA, 599 bp, Homo sapiens
  ENST00000467791
ccactggattagcagaccctggtgcagtggcttctatgttttgggttgatgccgaattagggagtgatatttaccttgatggtatcataactattgtggattcaaaatatggattaaaagcaaagaattggacaacttaaaatgacagctctctattctgaggacttgacacccgggctactgacattgttcttttcagttctacaaatgtgacagcatttaatgcaatagaagcaatgaatgaagttacccagagaaggtcaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagaacaataaacatgcagtgattgatttttcttacttcaagtggatgagtgagcaagtgactaaaatcttctgtgaattcttcagtagttgatctctctaatgtattagatcttcatgcctttgatagtctctctggaataagtttgcagaaaaaact

SEQ ID NO: 3343 - DNA, 369 bp, Homo sapiens
  ENST00000490294
gttctacaaatgtgacagcatttaatgcaatagaagcaatgaatgaagttacccagagaagcatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagaacaataaacatgcagtgattgatttttcttacttcaagtggatgagtgagcaagtgactaaaatcttctgtgaattcttcagtagttgatctctctaatgtattagatcttcatgcctttgatagtct

SEQ ID NO: 3344 - DNA, 1160 bp, Homo sapiens
  ENST00000610377
tgccgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggtcccagaagaagatgtaaagaaattaagaacgacacttaggtacaaaatgatgtgtgttaagtgcctacagatccatattgtatacacagaatgttttttactctgattgttgccctgtagaaacttaaggtataaggttgacctgcttcaagaacgttagggaatcacatatattgttgatggctaattgttatataaatggtaatacataaaattagtccccagtgcttgcagaatatagttcacagttaatagactgatattcagggtcttcgcactccatctttcttttcctgtcttctctttgactctttcctaatgtcagtcttccctaactttacccaggatggttaattcactttcccatggatgcatcctgtcagttcctgtctttactcataatgtattctcactctgccaatccctgagttctttcttgttctgtttttttttttaatttattctatagagcctattctgtctctccccccttcctatgtgaagtcttccctgactcaagtggtctcagttttccctgaactcttgttgacttcatcttccttaactgtcaaccatgcattgtcttccagcttgcttgtatatcttctttgtccatagccaaggctgatcagcataggacaatcaggacaatatgaatgatgctgaaatatgtgctaacagtcattttgctgactgttctggagactcccattccttttgaaaacaaagatggacttttcaaatgaagttatagttcagggactttgttttgaattattttgtaagacctgaactaataaaagccctatacagagagacattcggtagctattattattggttatctttaatgtgtacaatgctttgagcgtgatggctcaaaattactattcttagtatttataag

SEQ ID NO: 3345 - DNA, 452 bp, Homo sapiens
  ENST00000620776
tgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactaggcaagttgctttggcagatatcattctcattaataaaacagacttggtcccagaagaagatgta

SEQ ID NO: 3346 - DNA, 1820 bp, Homo sapiens
  ENST00000613716
gtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattg

SEQ ID NO: 3347 - DNA, 721 bp, Homo sapiens
  ENST00000617933
aagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagtgaaataccactaa

SEQ ID NO: 3348 - DNA, 1792 bp, Homo sapiens
  ENST00000377391
aagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttat

SEQ ID NO: 3349 - DNA, 1608 bp, Homo sapiens
  ENST00000456520
ggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgtta

SEQ ID NO: 3350 - DNA, 6227 bp, Homo sapiens
  ENST00000439986
cggagctcggcgctgggaagaagccgggagcttccctgatggtgccgccgcctccgagccggggaggagctgccaggggccagctgggcaggagcctgggtccgctgctgctgctcctggcgttgggacacacgtggacctacagagaggagccggaggacggcgacagagaaatctgctcagagagcaaaatcgcgacgactaaatacccgtgtctgaagtcttcaggcgagctcaccacatgctacaggaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaaggtgctggcctcaaacacctaccttccaggacctcctggcctgcctgggggccagggccctcccggctcaccaggaccaaagggaagcccaggcttccccggtatgccaggccctcctgggcagcccggcccacggggctcaatgggacccatgggaccatctcctgatctgtcccacattaagcaaggccggaggggccctgtgggtccaccaggggcaccaggaagagatggttctaagggggagagaggagcgcctgggcccagagggtctccaggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcacgccaaaggaagagaaagatcaactcacctgcagttaaaccatctaaagagaagaaagaccactggagacctagaaaacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtttcatgccatgcttatctgtaagtatcctatttagggaagaagattaaactctcttttcaaaaaaacaaagtgaaatgcctggattcacattaaaacaatgggctctcgtttgctataatattttaaagctgtttaatcaacagtggagtctgctctataaatatagattatttgttcaataaactggctgagcttagagagaggtgcagaattcctggttctgagcaggtgcccagaaggtaccattaggtgccatgatccaggctgaaccaatatacagtggggctgaagtctgcaaggaggttgctggcttgggctgacctcactaatgccatcagcagcggtaggtaaattttttctccttgggtattacaagtttttgtctggagccaaccaagcttgccaccaacatattgagagtaatacactattgaaagttatcttggatggggagaaaaaaaaatagtggttttccttgtttgcaaaaacttccttcctattctcattttttcttaattttctttaatttagtccaagttccagttcttttaggccttctctttgatttattttcccctgcatgtgagaagcagttcagaaaaaggtctatatctccacctcctagtgagttagagtgttttctcagagcacctctgggtggcaaagggaagcatgttcctgccaaggtttgctgtggattcagaagcaccaggagcaagagaccagaaggatgatctgctcctttgtaacgttgttgagggccctcttgtttccaatgagcagcttataggttactcacagtccactttctcactggacacacaaagtggctctttatctacctttgcgggagattttcactctcctgcaaatgatcgttctcacactcatattagctcatgttggaatttcccatcctgccatgtcctttcccatttctttttggcttttttgcctccaccttttagcccacatcatttaactccactactgtgaaagcttgcttaaagaaaatccctcttggccgggtgtggtagcccacgcctctaatcccagcactttgggaggctgaggcggggagatcacaaggtcaggagatcgagaccagcctgaccaacatggtgaaaccctgtctctactaaaaatacaaaaattagctgggcgtgttggcacacacctgtaatcccagctactcaggaggctgaggcaggagaattactttaacctgcggggggagcctagattgcgctactgcactccagcctaggcaacagagggagactctgtctcattaaaaaaaaaaaaaaaaaaaaaaaaaggccgggcttggtggctcatgcctgtaatcccagcactttgggaggccgaggcgggcggatcacgaggtcaggagatcgagaccacagtgaaaccctgtctctactaaaaacacaaaaaattagtcgggcgtggtggtgggcgcctgtggtcccagctgctcgggaggctgaggcaggagaatggcgtgaacctgggaggcggagcttgcgctgagccgagatcgtgccactgcactccagcctgggcgacagagcgagactctgtctcaaaaaaaaaaaaatatcccttttgttgtgtttgaatgccacctttcagtcttcttccttaagaatgttaggaaggggctttgcaaacctctagtggcaacagtcttccttcccttcttcctaccacgttggaaatgcaggactcatgtcagtcagcatgtgaccgagtctttcatgaacactttgctcctctatgtctcatttatgcaaaattcctggtgactctccactaacatttttaaagtgaaagcaaactttcactttaaaaaaagtgagcgagaggatcccttgagcccaggagttcaaggccagtctgggcaacatagcaagaccccatccctaaaaaaaaaaaaataagttttattaaatgtggcactttcccctagaagggcagtaaccccaggaaccagtctgcctcttttcgaataaaggagactttttaaaaagaaaaaatttctttttagggtggggtgctctttatctagcatctttccttcctccttctctctgcaaaattcaacattcatgacagagggccacaccaaccacgggtttatagagagaggaactgaacagctgttgattcccatctggaatatatttaatgtttgcctgcttgtggagcatggtatttaaagggtgtggatggatgaatgtttaaaaaaaaacacacaaaactatgcacaagctgtatgagagatggctaggtccatctatgattttttttaaaagaagaattttaataccttttctttgacagtgaactgtatttagaaatatgatctttattgtgaaatgctcataaaatgcaaccaaactgcatgtttggccataggctagaataatatattaaaagaattaatggaaagtagtattgtctgggtttcatgaaactattccagataatattctccagcaaaacttatggtaacctgtattttataatgtcaatctgctggaccaagttaatttagaaaataatttttaatcctcagattttcaaaacttggactactgcaagactgatatgtactttttatgcccaaatcatatttttcaaagataggacatcataaggcatcattatttctaatgtatcttttaactagatagaaaaagctttactgtctaaacaggacttctgctcaaaacctaatgggaaagctatttctggggtaagatttgtaacagtgcttctaggtcatttcatgttttatagggaaaaagatctttgtacacctcctcaacctgttagtagaaatgttgacttcgattttttgcaccctcttcacaggacctcataagttgcctctgttcttggaaagcaatgggaataaaaatatgctgttgaaaatagtgcatggggccaggcacagtggttatgcctgtaatcccaacactttgggaggctgaggcgggcgcatcatgaggtcaggagatcaagaccatcctgaccaacacgtggtgaaaccccatctctactaaaataaataaaaaaaaaaattagccaggcgtggtggtgcacgcctgtagtctcagctactcgggaagctgagacacaagaattgcttgaacccgggaggtggaggttgcagtgagccaagattgcgccactgcactccagcctggctacagagtgagactccgtctcgaaaaaagaaaatagtacatggagggcatgcattttagtttaggaaacccccctcccttcccagttccagagggagaaattataagctatactgtgccaaaagtgagtggggctgcagagagaatggtgccttttctcaccttctgagttaatgcccgacatctgccattggattcattgaccaaaggaagtcatttctactgtataaactcaggagtatcatagcccaacaagtaaataataaatgttcattggttttggaaggaaggaaaggtgagtattaccccaccaaataccagcgaagagcaccctggctttggccatctttccaaggttcataattgctgtgggcctggtgagccctgttcccaggtatgcaagggagggcttctccaggccagacatttctgtaggttttcaggtagcaactcccccatcatattttgggtgtcattccccactctctctccccacttctcagcctgtgccccagaaacaaccacagcagcctcattctgcagacttaacatctgtcaaataaccttcctgaaaaggaaagttattggaggaatccaggccaaacaacaagtagaatagagccatctaaagttattaataatgagttcagggaaatagatgaattttttcctggcatagtcaatatttatatctcacaacaagtcaaaaataattttccatttggaaaacaaaacacaccatgactgtaattgttaaggcatataatcatgaacttcacatgctccctcaacaaacgttactgctctagggaaatcatagaaaaggaccctcttactccccaggggatcaaagcaagtccccttaggaatttcatgtgtgccgtgggtctgtttttatttcacagtgactagtcatatactggagtagctctgttgttcattatttgtaacaggtccatgtaacagtcaagttagcattcaagcaattatggatgtgatactatgatgtacttttgttatgattgtatatgcttaataacaaagttatttttctt

SEQ ID NO: 3351 - DNA, 1691 bp, Homo sapiens
  ENST00000589116
gatcagggtcttcctggcatgtctaaataggaacagctgagcccagcttctagcagggcccctctccctctgtcctcccctcttccctgaccctggggcatgctggcaggacctgagagctgtaaaatcacccacagttgagccctcgcatgtcccgctgtcagctactctgtccctgggaccgcccttcccgatgctgtctctctgggtctggcttgcatccagcctcccagacaggactgagcctatctcctttctcaggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaaggtgctggcctcaaacacctaccttccaggacctcctggcctgcctgggggccagggccctcccggctcaccaggaccaaagggaagcccaggcttccccggtatgccaggccctcctgggcagcccggcccacggggctcaatgggacccatgggaccatctcctgatctgtcccacattaagcaaggccggaggggccctgtgggtccaccaggggcaccaggaagagatggttctaagggggagagaggagcgcctgggcccagagggtctccaggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcacgccaaaggaagagaaagatcaactcacctgcagttaaaccatctaaagagaagaaagaccactggagacctagaaaacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtttcatgccatgcttatctgtaagtatcctatttagggaagaagattaaactctcttttcaaaaaa

SEQ ID NO: 3352 - DNA, 587 bp, Homo sapiens
  ENST00000589419
ctttgcctgctgccatctatgtaagacgtgacttgttcctcctcgccttttgccgtgattatgaagcctccccagccatgtggaactgaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaagg

SEQ ID NO: 3353 - DNA, 5979 bp, Homo sapiens
  ENST00000398179
aggaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaaggtgctggcctcaaacacctaccttccaggacctcctggcctgcctgggggccagggccctcccggctcaccaggaccaaagggaagcccaggcttccccggtatgccaggccctcctgggcagcccggcccacggggctcaatgggacccatgggaccatctcctgatctgtcccacattaagcaaggccggaggggccctgtgggtccaccaggggcaccaggaagagatggttctaagggggagagaggagcgcctgggcccagagggtctccaggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcacgccaaaggaagagaaagatcaactcacctgcagttaaaccatctaaagagaagaaagaccactggagacctagaaaacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtttcatgccatgcttatctgtaagtatcctatttagggaagaagattaaactctcttttcaaaaaaacaaagtgaaatgcctggattcacattaaaacaatgggctctcgtttgctataatattttaaagctgtttaatcaacagtggagtctgctctataaatatagattatttgttcaataaactggctgagcttagagagaggtgcagaattcctggttctgagcaggtgcccagaaggtaccattaggtgccatgatccaggctgaaccaatatacagtggggctgaagtctgcaaggaggttgctggcttgggctgacctcactaatgccatcagcagcggtaggtaaattttttctccttgggtattacaagtttttgtctggagccaaccaagcttgccaccaacatattgagagtaatacactattgaaagttatcttggatggggagaaaaaaaaatagtggttttccttgtttgcaaaaacttccttcctattctcattttttcttaattttctttaatttagtccaagttccagttcttttaggccttctctttgatttattttcccctgcatgtgagaagcagttcagaaaaaggtctatatctccacctcctagtgagttagagtgttttctcagagcacctctgggtggcaaagggaagcatgttcctgccaaggtttgctgtggattcagaagcaccaggagcaagagaccagaaggatgatctgctcctttgtaacgttgttgagggccctcttgtttccaatgagcagcttataggttactcacagtccactttctcactggacacacaaagtggctctttatctacctttgcgggagattttcactctcctgcaaatgatcgttctcacactcatattagctcatgttggaatttcccatcctgccatgtcctttcccatttctttttggcttttttgcctccaccttttagcccacatcatttaactccactactgtgaaagcttgcttaaagaaaatccctcttggccgggtgtggtagcccacgcctctaatcccagcactttgggaggctgaggcggggagatcacaaggtcaggagatcgagaccagcctgaccaacatggtgaaaccctgtctctactaaaaatacaaaaattagctgggcgtgttggcacacacctgtaatcccagctactcaggaggctgaggcaggagaattactttaacctgcggggggagcctagattgcgctactgcactccagcctaggcaacagagggagactctgtctcattaaaaaaaaaaaaaaaaaaaaaaaaaggccgggcttggtggctcatgcctgtaatcccagcactttgggaggccgaggcgggcggatcacgaggtcaggagatcgagaccacagtgaaaccctgtctctactaaaaacacaaaaaattagtcgggcgtggtggtgggcgcctgtggtcccagctgctcgggaggctgaggcaggagaatggcgtgaacctgggaggcggagcttgcgctgagccgagatcgtgccactgcactccagcctgggcgacagagcgagactctgtctcaaaaaaaaaaaaatatcccttttgttgtgtttgaatgccacctttcagtcttcttccttaagaatgttaggaaggggctttgcaaacctctagtggcaacagtcttccttcccttcttcctaccacgttggaaatgcaggactcatgtcagtcagcatgtgaccgagtctttcatgaacactttgctcctctatgtctcatttatgcaaaattcctggtgactctccactaacatttttaaagtgaaagcaaactttcactttaaaaaaagtgagcgagaggatcccttgagcccaggagttcaaggccagtctgggcaacatagcaagaccccatccctaaaaaaaaaaaaataagttttattaaatgtggcactttcccctagaagggcagtaaccccaggaaccagtctgcctcttttcgaataaaggagactttttaaaaagaaaaaatttctttttagggtggggtgctctttatctagcatctttccttcctccttctctctgcaaaattcaacattcatgacagagggccacaccaaccacgggtttatagagagaggaactgaacagctgttgattcccatctggaatatatttaatgtttgcctgcttgtggagcatggtatttaaagggtgtggatggatgaatgtttaaaaaaaaacacacaaaactatgcacaagctgtatgagagatggctaggtccatctatgattttttttaaaagaagaattttaataccttttctttgacagtgaactgtatttagaaatatgatctttattgtgaaatgctcataaaatgcaaccaaactgcatgtttggccataggctagaataatatattaaaagaattaatggaaagtagtattgtctgggtttcatgaaactattccagataatattctccagcaaaacttatggtaacctgtattttataatgtcaatctgctggaccaagttaatttagaaaataatttttaatcctcagattttcaaaacttggactactgcaagactgatatgtactttttatgcccaaatcatatttttcaaagataggacatcataaggcatcattatttctaatgtatcttttaactagatagaaaaagctttactgtctaaacaggacttctgctcaaaacctaatgggaaagctatttctggggtaagatttgtaacagtgcttctaggtcatttcatgttttatagggaaaaagatctttgtacacctcctcaacctgttagtagaaatgttgacttcgattttttgcaccctcttcacaggacctcataagttgcctctgttcttggaaagcaatgggaataaaaatatgctgttgaaaatagtgcatggggccaggcacagtggttatgcctgtaatcccaacactttgggaggctgaggcgggcgcatcatgaggtcaggagatcaagaccatcctgaccaacacgtggtgaaaccccatctctactaaaataaataaaaaaaaaaattagccaggcgtggtggtgcacgcctgtagtctcagctactcgggaagctgagacacaagaattgcttgaacccgggaggtggaggttgcagtgagccaagattgcgccactgcactccagcctggctacagagtgagactccgtctcgaaaaaagaaaatagtacatggagggcatgcattttagtttaggaaacccccctcccttcccagttccagagggagaaattataagctatactgtgccaaaagtgagtggggctgcagagagaatggtgccttttctcaccttctgagttaatgcccgacatctgccattggattcattgaccaaaggaagtcatttctactgtataaactcaggagtatcatagcccaacaagtaaataataaatgttcattggttttggaaggaaggaaaggtgagtattaccccaccaaataccagcgaagagcaccctggctttggccatctttccaaggttcataattgctgtgggcctggtgagccctgttcccaggtatgcaagggagggcttctccaggccagacatttctgtaggttttcaggtagcaactcccccatcatattttgggtgtcattccccactctctctccccacttctcagcctgtgccccagaaacaaccacagcagcctcattctgcagacttaacatctgtcaaataaccttcctgaaaaggaaagttattggaggaatccaggccaaacaacaagtagaatagagccatctaaagttattaataatgagttcagggaaatagatgaattttttcctggcatagtcaatatttatatctcacaacaagtcaaaaataattttccatttggaaaacaaaacacaccatgactgtaattgttaaggcatataatcatgaacttcacatgctccctcaacaaacgttactgctctagggaaatcatagaaaaggaccctcttactccccaggggatcaaagcaagtccccttaggaatttcatgtgtgccgtgggtctgtttttatttcacagtgactagtcatatactggagtagctctgttgttcattatttgtaacaggtccatgtaacagtcaagttagcattcaagcaattatggatgtgatactatgatgtacttttgttatgattgtatatgcttaataacaaagttatttttctt

SEQ ID NO: 3354 - DNA, 568 bp, Homo sapiens
  ENST00000479631
gtgagattcaaagtgtgttaagggtatctagctggctttaaagatggagggggcaaggtggctcctagaaggtgaaattgaccagcagcctgcagggaacagggacctcagtccttcaactacctggaactggattctgtcaacactctgaatgggcctgaaagtggattttcccccggaacctccagataagagcccagggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 3355 - DNA, 386 bp, Homo sapiens
  ENST00000496027
gccttccctgcccagtccccacaggacctcacctagggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcag

SEQ ID NO: 3356 - DNA, 2943 bp, Homo sapiens
  ENST00000310232
agggcagcgcgtgtcggcgtccggaggaggtgacctagccgccgcggtcctagaagggagaagtggagagagaccgctggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaactgcagacagccctgaccaggctgtcagccaagggggccaccgacgcaggagccaagccaccgagggcccagatgggagacagagcattgctggagaccccagaggtgaaggccctgcaggacaggctggtggccaccaacttgaagatgagtgacctccgaaaccagatccagtctgtgaagcaggagctgcggatggcacagaaggttttggccagagaggttggggaagacatcaacgttcagcagctcctatcttcgccagggacctggaggggtcgggctcaacaaattcttgttttgcagagcaaggttcaagagcttgagaagcaattgggccaggcccggagccagtctgcgggaacagccagtgatgagttgtctgtctatccagacccaaggaagctgtcggcacaggagaaaaacctgctgaggatccgcagcctggaaagggaaaaacaggaaggcttggagaaacttgccagtgaacgggatgtcctccagagagagcttgaagagctaaaaaagaagttcgagggcatgaggtctcggaacaagctgctgtcaagtgagatgaagaccctcaagagtcagatgggaaccctggtggagaagggccggcatgatgacgagctcatcgacgccctcatggaccagctgaagcagctacaggagatcctaggcagcctgagtctgcaggaggagaaaacgcgagtgtcccagcaccacctggaccagcaactgaacagcgaggctcagcggagcaacagcctagtcgcccagctgcaggccatggtagctgagcgggaggccaaagtgcgacagctggagatggagatcggacaactcaatgtgcactatcttcggaataaaggagtgggtgaggggtccagtggccgcgaggtcagccctgcctatacccagttcctggaggacccaggcctgaccaagtccccggcctcagcaggcgatcatgttggcaggcttggatcttctcgctctgtgaccagcctgggccacacactggtggaatctgctctcacgaggccttccctgcccagtccccacaggacctcacctaggttctcggactccccagaacaaaaaggctggcaggcacaagtgtcagagatcaaggccctctggcaggctgccgaggtggagcgtgaccggctcaccgagtttgtcactgtcctgcagaaacgggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacaggtctgcccacctctaacaacaggcacaacccaaccgggagcgagaagaaggacccatcctttgcccagctctccgatgtgcccgtggaatcccaaatggaagagctgacaaccaggctggccatccaggtggaggagaatgaaatgctaaaggctgccctgggcagtgccctgcggggaaaggaggaggacttccggatgtaccatgagatcctgggccaggtgaaaagtgtcttcctgcaggccctgcggcagcagaagacaggcaagcaataggatgacagcccagtgtcggcctggccgggtgggcagcctcaggtcttgagaggataagactctgtctgaggactccatctgctccgggaagccagcccagggcagccagctcaaccacttctaccagaagaggctccttaaggatgaccaaaaccaatgtctcaggccaggaaggcagaagagaagccctggtgggacactgcaggagaccctgggctggctgggttacagcagcagggaggcccagcagcccactggcagaggcgagagctctgggatggcaaggcggctgtgaatggacagatgcagtccctcgggcaggtgttcatcgccctcatcctaggtactagccctggatgtccccatggcttcacacacagaagagcccttggttaccctaagtgggcatatcccccatgccactcagccctgccctatcccctcacccccatcccggctccatctgtagccgtccacaccctacacagacttggggcactatgctctcaaccagtttgtcagcccactcctcaggacacttcctcaggtgcagacccttggacttgtaataataataagtattttcataatcactgcagctcccagtgagtgagcatctactgtggcaacctgaccccattcagtcctctaatgacccaggggtttgttgtcttatttgacagatgaagaaactgaggttcacagaaagaa

SEQ ID NO: 3357 - DNA, 479 bp, Homo sapiens
  ENST00000466031
tgtggaggaagtcagagagggtagtgagattcaaagtgtgttaagggtatctagctggctttaaagatggagggggcaaggtggctcctagaaggtgaaattgaccagcagcctgcagggaacagggacctcagtccttcaactacctggaactggattctgtcaacactctgaatgggcctgaaagtggattttcccccggaacctccagataagagcccagggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacaggtctgcccacctctaacaacaggcacaacccaaccgggagcgagaagaaggacccatcctttgcccagctctccgatgtgcccgtggaatcccaaatggaa

SEQ ID NO: 3358 - DNA, 314 bp, Homo sapiens
  ENST00000472921
gttcctggaggacccaggcctgaccaagtccccggcctcagcaggcgatcatgttggcaggcttggatcttctcgctctgtgaccagcctgggccacacactggtggaatctgctctcacgaggccttccctgcccagtccccacaggacctcacctagggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacag

SEQ ID NO: 3359 - DNA, 597 bp, Homo sapiens
  ENST00000482100
acaccagattcgctgcagcttaagactagcctcacaaatcctttttctaattaattaaaactttacaggagataaacaatgatttttaccagtctgcacagagagagagagagagagagagagagagagagagagagagagaggaaagcactgcctgaggcagagtggggaaggtgaggtgctcagagaggccagagaaagacccacccattgcagcgacactgaaaagttcaggcggctgcttgtcaccatcagcgaagagtgcaagacagattaatccaaagagaatagcagttaacatcccggagtgccaaacccatttttagctgaaagggactttaccgagaggaactttactgagaggaccactaactccctacatcttagaagggactctaaccctcctaagttgggcctctaacccaagaatgccttaaccatctgggaatgcagcagttggtttcagccttatttcacccagctcctatttaagatggagttgctcttgttcaaacgcctctgacaaaaccactgtgctttggagagaacaacatggcggtggatggttgtggtattatgcaataacaacacaaaatg

SEQ ID NO: 3360 - DNA, 698 bp, Homo sapiens
  ENST00000479576
tttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaactgcagacagccctgaccaggctgtcagccaagggggccaccgacgcaggagccaagccaccgagggcccagatgggagacagagcattgctggagaccccagaggtgaaggccctgcaggacaggctggtggccaccaacttgaagatgagtgacctccgaaaccagatccagtctgtgaagcaggagctgcggatggcacagaaggttttggccagagaggttggggaagacatcaacgttcagcagctcctatcttcgccagggacctggaggggtcgggctcaacaaattcttgttttgcagagcaaggtgagtgagtcatcagacttctcctggcctgaacaaaggatttaaaacaccccagaaagagctgccctgacccccttagagacctaagcacacagtacccaaaaaaggcctttaggtctcacagtgcactcgtgcggggttgttgttttaccttctcgccaaccagcctgattttaatttgttattta

SEQ ID NO: 3361 - DNA, 1267 bp, Homo sapiens
  ENST00000492806
agggcagcgcgtgtcggcgtccggaggaggtgacctagccgccgcggtcctagaagggagaagtggagagagaccgctggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaactgcagacagccctgaccaggctgtcagccaagggggccaccgacgcaggagccaagccaccgagggcccagatgggagacagagcattgctggagaccccagaggtgaaggccctgcaggacaggctggtggccaccaacttgaagatgagtgacctccgaaaccagatccagtctgtgaagcaggagctgcggatggcacagaaggtctttcagagccagggcttggggcttcttgtgtggctggggctggacttgggaagagcacggctggcacagtggattcctttctggagccatgagtgctcagtcccttgagcacactgcttgctctgggtcaggctccagttccagtccttcctcccaccagcccttggtccataaccatttggtgggcagagtcgctggctacctgagcctgccacccccacccccgcagcatacctgcccttgtggtgcctgcccagctctagactgaggaggacagcactgtccacccagggagagtccattaagccttccctgcactacttgtgccccagtagatcctgggtctccccttaatgtcacccttacttaacttgaaagcctgccaacacctgccttcttctctgctatctgtaacagaaaatgaataggttacttgtgtattaaaggaccctttcaaagg

SEQ ID NO: 3362 - DNA, 821 bp, Homo sapiens
  ENST00000435327
gtgtcggcgtccggaggaggtgacctagccgccgcggtcctagaagggagaagtggagagagaccgctggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaactgcagacagccctgaccaggctgtcagccaagggggccaccgacgcaggagccaagccaccgagggcccagatgggagacagagcattggctgctcagggcggcccaagcccgagccacactccagaggcctgcaggctcaatccacattccaaccctaggcctccaaagcacattccagagtggagctgaacacccttccctctgcttggggcttcaggaggccgtgatgtg

SEQ ID NO: 3363 - DNA, 557 bp, Homo sapiens
  ENST00000415750
acatatcccaggaggcaatgcgcaggggagcacggaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcattctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagtaa

SEQ ID NO: 3364 - DNA, 3333 bp, Homo sapiens
  ENST00000285871
ataccaaggacgcgacttcttgtttggagagggtggagctttggagtgagacccaggaggccaaatcccaaagagaaaaataggagcctaaataaggatcaggaccaagggaagggaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcattctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagaaatggagaagaagatgaaaatattgagagaaagcactgaagaattacgtaaagaaataatgcagaagaaattagaaattaaaaatttacgagaagatttggcatctaaacaaaagcaattattaaaagagcagaaggaactagaagaattgttgggacatcaggtcgtcctaaaggatgaagtggcccaccatcaaaccattccagtacaaattggaaaagagatagaaaaaataacacgcaaaaaagtagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagatggaagctatccccaaagatgattctacattatctgagagaaggcgagagcttcacaaggaagttgaagtagctaagaggaatttggcccaacagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaa

SEQ ID NO: 3365 - DNA, 615 bp, Homo sapiens
  ENST00000461882
attcttctaagagagcagcaacaggaccacatatgcaaacttcatctcctactactagattgttcctcaggatcaaggagaaaagcttaaaggaagaaaaaatcatcatagtaaaagaatttgagaagataacaaagccaggagaaatggagaagaagatgaaaatattgagagaaagcactgaagaattacgtaaagaaataatgcagaagaaattagaaattaaaaatttacgagaagatttggcatctaaacaaaagcaattattaaaagagcagaaggaactagaagaattgttgggacatcaggtcgtcctaaaggatgaagtggcccaccatcaaaccattccagtacaaattggaaaagagatagaaaaaataacacgcaaaaaagtgtatgatttaatatttttactttgaatccctgccagtccaagttatgtgtgcacactagaacaagagtactaaccattggacacattaaattactatgataattttagaaatttctgctttgggccctgtctaggttgtttatatcaagttctttaaaagaaagtaatgcaccaaatttctatcattcatagtatttatggcttaattatgggtcaagatt

SEQ ID NO: 3366 - DNA, 2405 bp, Homo sapiens
  ENST00000415740
gtgtgtgtgtgtgtgtgtgtgtgtgtgtgtatcccctacagagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaatgg

SEQ ID NO: 3367 - DNA, 1554 bp, Homo sapiens
  ENST00000461259
ttgggactttcagagacattgtggctagccaaccacatggtcagcctcaaagttgagaggctcagtaaccctcctatccctagagaattccaaagtgtggatgtaatttaactagaaagccattggtgactatctgtgatcctctggaagtatgctatgttgtgtatatcttgcatccaaagccagagggaaccacaatgactagtaaaacggtggtctcaatgcccacttagcctctgcctctgaatttgaccatagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaa

SEQ ID NO: 3368 - DNA, 720 bp, Homo sapiens
  ENST00000474733
gtggtctcaatgcccacttagcctctgcctctgaatttgaccatagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatgctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcag

SEQ ID NO: 3369 - DNA, 567 bp, Homo sapiens
  ENST00000464021
gcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaaggtaaacattattgcttaaaattgcatctgttagctcctcgttgatgtagtttcacagatacctatggtactgtttcatgttatgctgacagacctatccttcattattctagtcactaatatagtccttttgttgtaatctagtcatacattctaagcttgatttagacacttgccaaaagaagttccaatccagtggtttcgagattccaaaggcacatttctctcatgacccaaaggagtaa

SEQ ID NO: 3370 - DNA, 726 bp, Homo sapiens
  ENST00000478101
gggggagatactgctctaattaggaaataagattttgtcttagatgactttttttttattcctcttgaaccaattttcaaacatagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggctt

SEQ ID NO: 3371 - DNA, 562 bp, Homo sapiens
  ENST00000488998
ggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgagtgagaacacgtcagaaatgtggaaggtaaaggttttatcggtgacttttcacgtcaaggatataatgcaatacagttaagagcatcagagagaagaaatatactttccaggtaatcagaacacctagattttttt

SEQ ID NO: 3372 - DNA, 3431 bp, Homo sapiens
  ENST00000361970
ccggaggaggggacagcattcaggggtgtaccaggccccagaggcagcggaaagggagactgtggggaactaggagcaacagcaggcatggaccaaagcagtgaaggatgtatgaaaaagattagcagtgtgaatcttgacaaacttataaatgacttctcacagatagaaaagaaaatggtagaaaccaatggaaagaacaatatactggatattcagttggaaaaaagtaattgcctattaaaagtaatgcaagcaaaggaggtctccattaaagaagaatgtgctactcttcataatataataaaagggctacaacagaccattgaatatcaacagaatttgaaaggtgaaaatgaacaactaaaaataagtgctgatcttataaaagagaagttaaagtctcatgaacaggaatataagaataatattgccaaacttgtaagtgaaatgaaaatcaaagaggagggatataagaaagaaataagcaaactttatcaggacatgcagagaaaagttgaattaaatgaagaaaagcacaaagaactaatagagaaaaaggagatggaaatttcagagttaaatgcaaagctaagaagtcaagaaaaagaaaaacaaaatgaaataatcaagctacaactagaatttgatgccaaactagcaagagttcagactaaatcaaaatcatatcaggattctactgttttgccacaaagtatctacagaaggaaacttcagcattttcaagaagaaaaaaacaaggagattgcaattcttcgtaataccattcgcgatttagagcaacgcctttctgttggcaaagattctcaccttaagcgtagacggttttgagcttagcagtaaattcattagttggtatttatttaaaagcaatcgaaagtttcacttctgttttcaatatatgcatacagcctacataacaaacgaagtcagctttaaggtttttattgaatttatttggacaaatccgtactgtatccaattctgtactgcattcttgcttaatagtattaaccataaaggaggtcaggtttatagggtttggtttacctattaaaccatcattgactatggaaatacttactaagcaatatagagacagacaatattatctttccccttatatcttttaagacagccactcaagttttagaagagtatgatacaacattagagaaagaaagatacaaaggctttattcatgtgtgatagtaaaaatcaggatgagtcttagatatacaaaagataaatggatatttaaaatagttatatatgcttttttagcaaaatattcacgtgttaagtatttctggatcttaaaatacaaaatccacttattttattagttaaaagtagaagattgaaaagacaaagtaatattgttttgagagataagtaaagaaaaaaatggaaagcatgtctttgttgttcttcctccattctaaactgctaattatccaacagaaacccctaggtcatagtttacgtttctattctcattaaagcaaatagaacactggaaaaagaaaaaaaaagacatattaaccaaaagctgcaatcacctttcagttgctccatcataaaaaatatggtttgagtcaatatttctatgacataaaatttaaaatctggaagccaattcagtagatttctccatgtttgcacaaatctaatttctatttttggttcactaatttggtagtttataaaaatgctggaaatgaaattgtgtctagactaaattggggagtatgtcctattttaaatatttagtttgaaggtcattctcacttttttgcctgattctttcagcgtcaactggcactggcttctgtgggtataagctgctgacttatttgtcaggcagctggaggcaaacgtcactgacaagattcagttatgttctcctctgcccgaagtccctgtcagctacataaagatgggaggttttctttacactgtcaggtgattgcagaccctgttttttcaaatatcagatgtcgacaatggcagcatcagctcctaggagccaactctgaatctgtgggcaatttacagagtaattgatttatacatctctttcgacagagcttcttttgtaaatcttgtaaatcttcacttgctggcatatctcggttctctgggtgaccctgcctatgctgacccttgtgcttatggtggtgatgaaggcctggaggagcaggatgagtaggagcatttggtgctcctggttgctgattctctgaaagctcactgctgccaaggtgctgatgtccatgattgtgatgatgctcatgatggtaatgaggcgatggagtttcaactgttttatccacagtagccaaagatacacgtttacaaaagtcttcatctttgagagtctggaacaaatttataaatcactttttaacaagcttatagagataggaataatgcgtgaaaaatgatttgtagagctaacatgtgaaattccaactagttaattagaatcgagctggctttgtattatattaatgagaaagagtctgatgttagtctcaacacctagacattttattaaaggcttaaaaagaaagccaaaccactgtacttatatttgcagaagcaaatgaagtaaactggcaaaaggaacttggattgcaggaaagtcaaagtaatatcaaatcctaaattcagttgatctgggccgagcatggtggctcatgcctgtaatcccaccactttgggtggccgaggggggcagattacttgggctcaggagtcggagaccagcctgggcaacatggcgagatcctgtctctgcaaaatatacaaaaattagctgggtgtggtgtcagatgcctgtagtcccagctacttgtgaggctgaggtgggaggatcgtttgagcctgcaagatggaggttgcagtgagctcagatggtgccactgcactccagcctgggtgacagagtcagaccctatctcaaaaaaataaaaaataaataaaaaatcagttgaactatatggaaacttctgtacctgtgtcaacggtgcatcttatctaatactatatgatactgtaatctaatattatctctgataattcaaaaatgctaataaactctgctcaaatgtgttagtttttcatacttcatcctatgccaggaaatgttttgaacttcaccaaagctttgctaatgtctccctaccataaggctgtcagctgaaaatagcaaattactgcccgactcccattgaccataatatccattccgcatgatcctagttctttaatttactggaagtctttactgttttgtggtacctactaatcagagactcaaagcctatagatacagaaatgtaacagtaaatctcaacctaaggctaatttgcaaataaaattacaaaatcaacttagaacccaaa

SEQ ID NO: 3373 - DNA, 1237 bp, Homo sapiens
  ENST00000388827
attcaggggtgtaccaggccccagaggcagcggaaagggagactgtggggaactaggagcaacagcaggcatggaccaaagcagtgaaggatgtatgaaaaagattagcagtgtgaatcttgacaaacttataaatgacttctcacagatagaaaagaaaatggtagaaaccaatggaaagaacaatatactggatattcagttggaaaaaagtaattgcctattaaaagtaatgcaagcaaaggaggtctccattaaagaagaatgtgctactcttcataatataataaaagggctacaacagaccattgaatatcaacagaatttgaaagttgaattaaatgaagaaaagcacaaagaactaatagagaaaaaggagatggaaatttcagagttaaatgcaaagctaagaagtcaagaaaaagaaaaacaaaatgaaataatcaagctacaactagaatttgatgccaaactagcaagagttcagactaaatcaaaatcatatcaggattctactgttttgccacaaagtatctacagaaggaaacttcagcattttcaagaagaaaaaaacaaggagattgcaattcttcgtaataccattcgcgatttagagcaacgcctttctgttggcaaagattctcaccttaagcgtagacggttttgagcttagcagtaaattcattagttggtatttatttaaaagcaatcgaaagtttcacttctgttttcaatatatgcatacagcctacataacaaacgaagtcagctttaaggtttttattgaatttatttggacaaatccgtactgtatccaattctgtactgcattcttgcttaatagtattaaccataaaggaggtcaggtttatagggtttggtttacctattaaaccatcattgactatggaaatacttactaagcaatatagagacagacaatattatctttccccttatatcttttaagacagccactcaagttttagaagagtatgatacaacattagagaaagaaagatacaaaggctttattcatgtgtgatagtaaaaatcaggatgagtcttagatatacaaaagataaatggatatttaaaatagttatatatgcttttttagcaaaatattcacgtgttaagtatttctggatcttaaaatacaaaatccacttattttattagttaaaagtagaagattgaaaagacaaagtaatattgttttgagagataagtaaag

SEQ ID NO: 3374 - DNA, 2378 bp, Homo sapiens
  ENST00000447857
ctccttttgctttttctggcgggaaaagctcacgcgcacctcccccaactcaactgccgttcgtcgttcgtggatgtccgttgtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatgagctacctgaaggggcccagctgagaagagtgggctggaccgagctgctacccccatcgctgggcttggagatcgaggccattcgacagaaacaggaagtggcaactgctgatctctccaaccctctgtgtggggtgtggcagtgggaggaagtcatccatgagaccagtgaggaaactgagtttccatctgaagccccagctgggggacagagaaacttccagggagagccagcgcaccctgaagaaggaaggaaggagccatccatgtggttgaccagaagagaggaagaggaggatgcagagagccaggtcacggctgatctccctgtccctctaggagcccctcgccctggagacatcccagaaaaccctccagagagacctgcgcggcgggaactccagcaagccctggtgcctgtgatgaaaaagctggtcccagtcaggaggagggcctggggccagctctgcctgcccccacagcggctcagagtcactcgacatccactgatcccagctcctgtcctgggcctgctgctgctgctgctgctctctgtcctgctgcttggcccgtccccacctcccacctggccccacctccagctctgctacctccagccccctccagtgtgagaggctctacttgcccctcagagcagtgtctagctcaataaatcccctggccctctctccactgggatccccattgttagtccactgttgcgcaggcttaccctagatagagtacaggggatccacatccctgtatttttatgtgaagtctcctagttttttaatgctgacatttcttaacaatagcaaaactcccccagtaatggattaagcactaaggattattccctcacaaaacaagcctggcgagggcagctgtgggcacacagctaagtctcggttgccttggggtcagggcctcagtgattctcctgtcccctccctcatgctcaggagttggcagttgtagcttcctacatcacatctgcgggaaacggaaatttcttccttcctttttataaagagaggcagtagcctcagtgtgcagtgggtagattcaaatcatattcataataaaagagaagcagttgcctgcccagagcca

SEQ ID NO: 3375 - DNA, 530 bp, Homo sapiens
  ENST00000600895
tccttttgctttttctggcgggaaaagctcacgcgcacctcccccaactcaactgccgttcgtcgttcgtggatgtccgttgtgtcccgagactaggacgtggctccagtgtacctccgggagcggcctgaggaggcaaggctgggaatgccggtcagcttggaggagcaaatactcaactccacgttcgaagcttgtgaccctcagaggacaggtggtgggggcatgaggggtgctggggaccagtgcgggcaggatggggtggaggctgggaactggggagcctcagagagaagactgggctaaggccccctcttgggggtattgtaagaacaaagtgggtgattatgggaagcttcaggaagaagaacgtggataatggggtgaaggccttttagaatgaggaaaacttgggggacgttgatggaagagggcagagttttggggtcgtgggataggggagggaggcagccaccatggtggcgtggggcatggctgatgctgtccctatgtccatcccctttggttta

SEQ ID NO: 3376 - DNA, 570 bp, Homo sapiens
  ENST00000598730
gttcgtggatgtccgttgtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaagaaagaggtaacaccaaccccattttccagaggaagaaactgaggcccaagagaagttgagtccattgccccagtgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagagga

SEQ ID NO: 3377 - DNA, 2014 bp, Homo sapiens
  ENST00000596771
gttcgtggatgtccgttgtgtcccgagactaggacgtggctccagggtgttccagaccctggaagggcctctcttcaaagacccgtgtttccagaacggtggcagcgggctcacgtggcttggggagagcaggcactgggggagctgggtgaggacaggcgagcccaggctcgactggtggccccaaggggcgcccgtgcccgctgtgatgatagcagcgcccaggtctctctctagcccccagagtgcggccactaaggttttgggtcggcctgggtggaatggaggcaggatggggccccccaaactcctgtcactgctgcagggactgcccagagcagctgcaagtggggctggcagggatgaggaggaggtggcctgggcttgggggaccatgtacatcctgagttggaacccaggggagcagcaggtttggggccatgatgaggagagacctaggggttgcccgacggagagaaaagggacaggaagaggcaggagcttcagagactactcaatgccactctagcctgagggactggaacttagtccgggggcattagggagccatgggaggatcaggagcaggggcaagtcaggatcaaactcccatgagaagccagccggccaaatccaggctgatgtggcaagaatggcagctgcccagggctgtgtgggagccagacacggcccctcgcttcccggaagaggccacgtgaagccgaagcaggatgcaggagggcgtcccaggcagagacctgggcatgggagcggtccgcagctcagagtggctggagcatcatgtgcgatttggggtgctgaggagtgctcgggccagctggtccttttcccatccctccccatgaaggagggaggctggtagctttgccagcagctgcgccgcggcaggggtggcccatggacctgcccgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggaggtgagcggaggcccagcaccacccccaccccttccccagtccttaaggtcttcttgacaccactcccttctgcccccaacaccccagcagcctgtcttggggagacctcagaatgtcagtagtgtgggaatgtccctgaggttatatcacactgtgagaacagccgtggtttacaagagtgtgaggcatggggtcagcctacatggcttcaggctgaggccacctacataagagtggaccagtgcctcccttctctgtgcctcagttgcctcacctataaagatgaacaaaacaatgg

SEQ ID NO: 3378 - DNA, 570 bp, Homo sapiens
  ENST00000596862
gtggatgtccgttgtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaatgtacctccgggagcggcctgaggaggcaaggctgggaatgccggtcagcttggaggagcaaatactcaactccacgttcgaagcttgtgaccctcagaggacaggtggtgggggcatgaggggtgctggggaccagtgcgggcaggatggggtggaggctgggaactggggagcctcagagagaagactgggctaaggccccctcttgggggtattgtaagaacaaagtgggtgattatgggaagcttcaggaagaagaacgtggataatggggtgaaggccttttagaatgaggaaaacttgggggacgttgatggaagagggcagagttttggggtcgtgggataggggagggaggcagccaccatggtggcgtggggcatggctgat

SEQ ID NO: 3379 - DNA, 473 bp, Homo sapiens
  ENST00000597993
gttgtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaagtgctccagaaggagagactgccctgttggctgggaccccagagcaactcctgactcactgtgggagctcacttactgttgagtgaacggacggatgaaagaggtaacaccaaccccattttccagaggaagaaactgaggcccaagagaagttgagtccattgccccagtgtacctccgggagcggcctgaggaggcaaggctgggaatgccggtcagcttggaggagcaaatactcaactccacgttcgaagcttgtgaccctcagaggacaggcactgtggctgtggcccaggtgctggcc

SEQ ID NO: 3380 - DNA, 564 bp, Homo sapiens
  ENST00000593725
gtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaagaaagaggtaacaccaaccccattttccagaggaagaaactgaggcccaagagaagttgagtccattgccccaggtgccaccacttgtctgaggccaagcctcggttgccccctggatctaccccgtcctgcagcctgtgctcagtgagctgctgcacccagctgttcaaggccagggcagggagcctagaagttcacttccagccctgggagagaggctgggccagcccagtggctcctgcagttgaggatctcttcctatgtcatggagcatttgttgagcacctgccatctgcaggtgttgtggctacaacagtagacaaatagaccccaggacgtgtgtgtgtgtgtgtgtgtgtgtgtgtgtgtgtgtgtacatgcgtgtgcttcacatacac

SEQ ID NO: 3381 - DNA, 531 bp, Homo sapiens
  ENST00000594905
tgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaattcaggtgctccagaaggagagactgccctgttggctgggaccccagagcaactcctgactcactgtgggagctcacttactgttgagtgaacggacggattgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtga

SEQ ID NO: 3382 - DNA, 768 bp, Homo sapiens
  ENST00000595828
cgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaagaaagaggtaacaccaaccccattttccagaggaagaaactgaggcccaagagaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttgg

SEQ ID NO: 3383 - DNA, 776 bp, Homo sapiens
  ENST00000594043
cgaaatcctagcgaagcccccccatattgtgggagagatacccctgcgtcagggccccccagatcctgaccacttgggaggccgaggcgggcggatcacgaggagtgctcgggccagctggtccttttcccatccctccccatgaaggagggaggctggtagctttgccagcagctgcgccgcggcaggggtggcccatggacctgcccgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggagggg

SEQ ID NO: 3384 - DNA, 2052 bp, Homo sapiens
  ENST00000600570
caactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatgagctacctgaaggggcccagctgagaagagtgggctggaccgagctgctacccccatcgctgggcttggagatcgaggccattcgacaggaagtggcaactgctgatctctccaaccctctgtgtggggtgtggcagtgggaggaagtcatccatgagaccagtgaggaaactgagtttccatctgaagccccagctgggggacagagaaacttccagggagagccagcgcaccctgaagaaggaaggaaggagccatccatgtggttgaccagaagagaggaagaggaggatgcagagagccaggtcacggctgatctccctgtccctctaggagcccctcgccctggagacatcccagaaaaccctccagagagacctgcgcggcgggaactccagcaagccctggtgcctgtgatgaaaaagctggtcccagtcaggaggagggcctggggccagctctgcctgcccccacagcggctcagagtcactcgacatccactgatcccagctcctgtcctgggcctgctgctgctgctgctgctctctgtcctgctgcttggcccgtccccacctcccacctggccccacctccagctctgctacctccagccccctccagtgtgagaggctctacttgcccctcagagcagtgtctagctcaataaatcccctggccctctctccactgggatccccattgttagtccactgttgcgcaggcttaccctagatagagtacaggggatccacatccctgtatttttatgtgaagtctcctagttttttaatgctgacatttcttaacaatagcaaaactcccccagtaatggattaagcactaaggattattccctcacaaaacaagcctggcgagggcagctgtgggcacacagctaagtctcggttgccttggggtcagggcctcagtgattctcctgtcccctccctcatgctcaggagttggcagttgtagcttcctacatcacatctgcgggaaacggaaatttcttccttcctttttataaagagaggcagtagcctcagtgtgcagtgggtagattcaaatcatattcataataaaagagaagcagttgcctgcccag

SEQ ID NO: 3385 - DNA, 800 bp, Homo sapiens
  ENST00000596130
gcaatccccctgcctgtggctggtgaggactgaggggcagctacagtggggcgctaagcctcatccctttgatacaggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatga

SEQ ID NO: 3386 - DNA, 658 bp, Homo sapiens
  ENST00000593631
aatgagtcaggggctgtggacagtgacctgaaccccttccttgcccctagacaagccacagctgacctgctgagcagcctggaggacctggagctcagcaaccgacgtctggttggggagaatgccaaattgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggtgggtctggcccaggggaaggaaggtgccctctctcttctttgtttcctggagtcagggcggcagagtgtgactatggagtaggaaggggcagaggtcacctggctttctccctctctccaggccctgctcaccctagactttttcaagcttacctgccatccttctcatgacaaaggagacagcaggagccatcagggcttcccagacccattcccccaggccctggttgtgttttcaggggtgggagaagggcaacatgggggcaaggaggctagaaatgaaacctttgtcctctctctggggttggtcaggaaaaggagcagca

SEQ ID NO: 3387 - DNA, 1039 bp, Homo sapiens
  ENST00000593362
cccagaccctggaagaatacagagtgacgacgcaggaactgaggctggagatttcacgcctggaggagcagctgagtcagacctatgaggggcccgatgagctacctgaaggggcccagctgagaagagtgggctggaccgagctgctacccccatcgctgggcttggagatcgaggccattcgacagaaacaggaagtggcaactgctgatctctccaaccctctgtgtggggtgtggcagtgggaggaagtcatccatgagaccagtgaggaaactgagtttccatctgaagccccagctgggggacagagaaacttccagggagagccagcgcaccctgaagaaggaaggaaggagccatccatgtggttgaccagaagagaggaagaggaggatgcagagagccaggtcacggtaggcagtccccagcacccctccccagtccccatccactccacacccacagaggctgagtcgtttcaactcttcccaagccccagcctcacactccaactcctcaggagcagagagaaaaatcatttggccaagagataacaaggcctttgctgtagctaatgagagcgatggtgaggtggggggaggcctggaggctagtgggcggccaggctgctcccaggggaccctcccagccacacacacagggctgcagccaccacaccgcaggcctcatagacgtggctacacccccggattgcataaatgcacacgcacatgcgcccacactcgggagaggttgggccggccctccccagccagcctcagaactccctgggggcgtagtgcccgcagcccccctgcctgcagccacacaggccagttcctctgctcctcagagcccagtgcccggtgggggttaagatttccattctcaggcaaggacggggaaagaaacttggtaaggagaggtgaggagccctcagttgtgagctgaggaatgcaggagctgggctggagtctgcctgttgtgggtcaggcactgtcagggcccctggggctcttcagggtccaaaccggcc

SEQ ID NO: 3388 - DNA, 452 bp, Homo sapiens
  ENST00000596419
aggtctaggctgtctgtctccctaggaactgaggctggagatttcacgcctggaggagcagctgagtcagacctatgaggggcccgatgagtgagtggaatttcaaggggtaggaggaggcaggaggggagcctaagggcagggacaccctggcctccagccccaaggtgggcagggaagggaggccagcatgagctgactgagtggccaccaggcacagaggccatcttcctccctccttcctgtgtggccaggctacctgaaggggcccagctgagaagagtgggctggaccgagctgctacccccatcgctgggcttggagatcgaggccattcgacagaaacaggaagtggcaactgctgatctctccaaccctctgtgtggggtgtggcagtgggaggaagtcatccatgagaccagtgaggaaactgagtttccatctgaagcccc

SEQ ID NO: 3389 - DNA, 326 bp, Homo sapiens
  ENST00000553317
atggctacgagggagtcttgaagggctgcgtttgcttgtggaacaggaatcaccaatggaccttcttaagaagaagaaacacattcgtacaagggttcatttcccagtggttaaatgtactgagaaaaatacattaacaaagtaactcaaggatacaactgctgtgaattcaaaagacagactactacaggaaaagaacaataatccaaacaaatcttgaaccaatctataaacagaaaacctgttatataaattattatctatttttgcaatacatcaaaatactgtattgatgaaaataaatagataacaaaaaacaatataca

SEQ ID NO: 3390 - DNA, 2616 bp, Homo sapiens
  ENST00000537690
gtggcaaccggcaatccttggctctggcttaggaggcgctcaagtagagcggcaaaatggccctgagcccctggaccccagggctgggcgctggcgagaagctggtgcaggcggctgccgtctccactggcccctccctggagttatgcaccttaccctccaccctgggctcctcggtcgcggtcgaggcgctggagcagctgtttgttgtggaacaatcactgcaaagtgactattttaaatgtaatgaagaagctaagatctttcttaaggacattgctgtagctgttaagaaattggaagaaatgagaaaagccacaatcgatcttttggagattgaaagcatggaactcaacaaactatactatctattggaaactcttcccaatagcattaagagggaattggaagaatgtgtccgagacgctcgcagattaaatctttttgagataaatacaataaaaatgagaattacaaggacagagaatgaaatagagcttctgaagaagaaaataactgacctgacaaaatataatgaagctctgggggagaagcaggaagagctagcaaggaagcatgcaaggtttgtcctgtcactcaaccaaactatggagaaaaaagccaccaccactgtttacataaatgagacttataccaaaataaacttgaagagagaagacatagcattgcaaaaaaaatgtattcaagaggcagaggagctaatggaaaaagaaagggcagaatatctaataagaaaacaagagttgactgcacagattaatgaatttgaaaatacccgtgaagtaaagagaatggagacttatcaaaagaagaaagaattggataaattacaaactaaaatgtcaaaaataaaagaaacagttactgtttccgcagcggttcttagtgatcacaatttagagatagcacgactacacgaatcaataaggtattgggaacaagaggtcagtgagctaaagaaagaccttgcaattctggaggcgaaactgtgttttttcacagataacaaagaaaaactagatgatatatctaatgatgaaaaaaatgaattcctgaacaagataaaacagctggttgaaacactgcatgctgctcgtatggaatacaaagacctacgagagaaaatgaaaactcttgccagacaatataagattgttttaagtgaggaagaaaaagcttttttgcaaaaacaaaagattcatgatgaaaatcagaaacagctgacatttatttctcagaaagaatactttctgtcacaaaagagagtagacatcaaaaatatggaagaaggactcatcacactccaggaacttcaacaagcaacaaaaacagtgtatcagcaacaaatcaaaatcctgagtgctaacctggaaagagaaagtcagagatgtgttataactcagtggaaaatggcttgcttgagaaaaaagcatgcacgttggacagccaagataaaagctgaaatacaagctattacagaaaaaattcagaatgcagaagttagacgaattgaattacttaacgagaccagtttcagacaacaggagatcagtggatttgtggcacagattgaaaaacttacaacagaattaaaagaagaggagaaagcatttgttaacaaagaaaaaatgttaatgaaagagttaagcaagtatgaggaaatatttgttaaggaaacacaaattaacaaagaaaaggaagaagaactagttgagtatcttccacaacttcaggtggcagaacaagagtataaagagaaaagaagaaagttagaagagctcagtaatattattacagcacaaagacaggaggaagatttactgaacaatcacatttttctgtttacaagggacttttcaagatacattagcaacatggaagatgtaaaacaagaattacaacaattacgagatcaagaaagcaaaaaaaacaaagatcattttgaaactctaaagaacttagaaaatggattctatataaatgaccaaaaagcagatcttctgctcctggaaaataaaaaattaaaagaatatattttatacttgaagaataacatagagaaatacagagaaggacaagaagccctcatgcacacctcaagcgacttgtctcggcaactaatagctcaggaggcacaatataaggatttgtgggctgaatttcagaccacagttaagatcttggtggacaatggtgaagagaccttgcaagacataaacaatctaacagacaagctgcgtgaaagagatgaaaaaatgcagcatgtcagtacatggctacgagggagtcttgaagggctgcgtttgcttgtggaacaggaatcaccaatggaccttcttaagaagaagaaacacattcgtacaagggttcatttcccagtggttaaatgtactgagaaaaatacattaacaaagtaactcaaggatacaactgctgtgaattcaaaagacagactactacaggaaaagtgagtgcacttactttcatattttgcagctgttaatagaagtcttaaacatttaaaatttaactaattcacacaacctccaccaagtatcagtaaataaacttctaaacaataaaaatggataaaca

SEQ ID NO: 3391 - DNA, 573 bp, Homo sapiens
  ENST00000556936
cttccttgttctgctctggttgactgggggagaggtggttttgataagagggtgacatcgttcattagggtctaacaagtggcactgtgataaaatgattaatgaatttgaaaatacccgtgaagtaaagagaatggagacttatcaaaagaagaaagaattggataaattacaaactaaaatgtcaaaaataaaagaaacagttactgtttccgcagcggttcttagtgatcacaatttagagatagcacgactacacgaatcaataaggtattgggaacaagaggtcagtgagctaaagaaagaccttgcaattctggaggcgaaactataacaaagaaaaactagatgatatatctaatgatgaaaaaaatgaattcctgaacaagataaaacagaaatcagaaacagctgacatttatttctcagaaagaatactttctgtcacaaaagagagtagacatcaaaaatatggaagaaggactcatcacactccaggaacttcaacaagcaacaaaaacagtgtatcagcaacaaatcaaaatcctgagtgctaacctggaaagagaaagt

SEQ ID NO: 3392 - DNA, 631 bp, Homo sapiens
  ENST00000556996
aattaaaattcagcatcagatctgttatgattgtttcttccttgttctgctctggttgactgggggagaggtggttttgataagagggtgacatcgttcattagggtctaacaagtggcactgtgataaaatgattaatgaatttgaaaatacccgtgaagtaaagagaatggagacttatcaaaagaagaaagaattggataaattacaaactaaaatgtcaaaaataaaagaaacagttactgtttccgcagcggttcttagtgatcacaatttagagatagcacgactacacgaatcaataaggtattgggaacaagaggtcagtgagctaaagaaagaccttgcaattctggaggcgaaactgtgttttttcacagataacaaagaaaaactagatgatatatctaatgatgaaaaaaatgaattcctgaacaagataaaacaggtaagaaggcagaagtcatgacttttacattataattacatttcatttttagttaatgtttaaaatatgtgagaaatatagaatttttcaaaaggatgtttttcattgaccaataatatggttgtttgtagtaatttaaaaaattttatctcctcccaaagtactttaattatatcaaagagc

SEQ ID NO: 3393 - DNA, 2487 bp, Homo sapiens
  ENST00000281581
atggccctgagcccctggaccccagggctgggcgctggcgagaagctggtgcaggcggctgccgtctccactggcccctccctggagttatgcaccttaccctccaccctgggctcctcggtcgcggtcgaggcgctggagcagctgtttgttgtggaacaatcactgcaaagtgactattttaaatgtaatgaagaagctaagatctttcttaaggacattgctgtagctgttaagaaattggaagaaatgagaaaagccacaatcgatcttttggagattgaaagcatggaactcaacaaactatactatctattggaaactcttcccaatagcattaagagggaattggaagaatgtgtccgagacgctcgcagattaaatctttttgagataaatacaataaaaatgagaattacaaggacagagaatgaaatagagcttctgaagaagaaaataactgacctgacaaaatataatgaagctctgggggagaagcaggaagagctagcaaggaagcatgcaaggtttgtcctgtcactcaaccaaactatggagaaaaaagccaccaccactgtttacataaatgagacttataccaaaataaacttgaagagagaagacatagcattgcaaaaaaaatgtattcaagaggcagaggagctaatggaaaaagaaagggcagaatatctaataagaaaacaagagttgactgcacagattaatgaatttgaaaatacccgtgaagtaaagagaatggagacttatcaaaagaagaaagaattggataaattacaaactaaaatgtcaaaaataaaagaaacagttactgtttccgcagcggttcttagtgatcacaatttagagatagcacgactacacgaatcaataaggtattgggaacaagaggtcagtgagctaaagaaagaccttgcaattctggaggcgaaactgtgttttttcacagataacaaagaaaaactagatgatatatctaatgatgaaaaaaatgaattcctgaacaagataaaacagctggttgaaacactgcatgctgctcgtatggaatacaaagacctacgagagaaaatgaaaactcttgccagacaatataagattgttttaagtgaggaagaaaaagcttttttgcaaaaacaaaagattcatgatgaaaatcagaaacagctgacatttatttctcagaaagaatactttctgtcacaaaagagagtagacatcaaaaatatggaagaaggactcatcacactccaggaacttcaacaagcaacaaaaacagtgtatcagcaacaaatcaaaatcctgagtgctaacctggaaagagaaagtcagagatgtgttataactcagtggaaaatggcttgcttgagaaaaaagcatgcacgttggacagccaagataaaagctgaaatacaagctattacagaaaaaattcagaatgcagaagttagacgaattgaattacttaacgagaccagtttcagacaacaggagatcagtggatttgtggcacagattgaaaaacttacaacagaattaaaagaagaggagaaagcatttgttaacaaagaaaaaatgttaatgaaagagttaagcaagtatgaggaaatatttgttaaggaaacacaaattaacaaagaaaaggaagaagaactagttgagtatcttccacaacttcaggtggcagaacaagagtataaagagaaaagaagaaagttagaagagctcagtaatattattacagcacaaagacaggaggaagatttactgaacaatcacatttttctgtttacaagggacttttcaagatacattagcaacatggaagatgtaaaacaagaattacaacaattacgagatcaagaaagcaaaaaaaacaaagatcattttgaaactctaaagaacttagaaaatggattctatataaatgaccaaaaagcagatcttctgctcctggaaaataaaaaattaaaagaatatattttatacttgaagaataacatagagaaatacagagaaggacaagaagccctcatgcacacctcaagcgacttgtctcggcaactaatagctcaggaggcacaatataaggatttgtgggctgaatttcagaccacagttaagatcttggtggacaatggtgaagagaccttgcaagacataaacaatctaacagacaagctgcgtgaaagagatgaaaaaatgcagcatgtcagtacatggctacgagggagtcttgaagggctgcgtttgcttgtggaacaggaatcaccaatggaccttcttagtaagcaacagcttagagctttgctggtaacatcaaaagaagaaaaaacgtgtcaactaagtgacttagttatccccaattatgccacaaacattcaattgaacattgatacttatttggggttgaatactcttgtagtgttatccaattctgcctttcacctaagagaattttctagataa

SEQ ID NO: 3394 - DNA, 545 bp, Homo sapiens
  ENST00000472746
gcgttgccttggagaccatgggcgtccagctgcagttgtcgctggaccggccctggctgccttgagagagtcccttcggatttgcgccatgcgcggcggggagaaccggcctcctgctcgagttcagagctcatctgaggttagtttcatcgtttcgttgaaagttaaaaccctaagtcgacgttccccagccgcctaccccccagcagagagtccttccccggggagtcctgccctggggtgccgcctcgaggccagacgtcgtcccgcctggacctgaacctgagtttgggacgggcgatttcccaacctcaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacc

SEQ ID NO: 3395 - DNA, 2781 bp, Homo sapiens
  ENST00000494917
atgggcgtccagctgcagttgtcgctggaccggccctggctgccttgagagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacagtgagtaaaaaactattttattctcatcctgttgttctgagttttgtaaacaaggtgaaatattaaaaaaaaaaaaagga

SEQ ID NO: 3396 - DNA, 3040 bp, Homo sapiens
  ENST00000460482
tgccttgagaggtgctttctgcaggcggggacgcggccaggccggacgcaaggcctccctccaatctaccgggctcagggggacggccaggggctgctcagtctacttggcgggctagggagggggatggcagaggctggttgggtcttctcagcacacagtaggcgcctaattagcgtgacctgaatcagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaccgggcatggtggtgtgtgcctgtaattccagctactcaagaggctgaagcaggagaatcgcctgaacccaggaggcggaggttacagtgaaccaagagagtgctgctgcactcctgactgggagacagagtgaaactccgtctcaaaaaaaaattaaattatatattctatataaggctttgtcagataaataaatggcaaatgttc

SEQ ID NO: 3397 - DNA, 5242 bp, Homo sapiens
  ENST00000529487
gagcgccgttaacttttccccgaagagcatggcagagtgaagcacaagcaataatcctgtattattcgcgttcccagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaacttcgagctggcttcttcgagcaccttgagaagtggtttgaccagtgttccctcaacacccgggtcaccgtggccaccaaaatcaatgagctggattcagaactggagctgcatctgcacctgcaccagccaagagcccagcagattgaaaaagacatccacaacgtcagggcagccgagcttttgcttcatcaagagcagttggacagccactgtgctggggtgaccgagacgctgaagaagaagcggctgatgttctgccagttccaagaagagcaaaacgtgaggagcaaaaacttccgccttaagatctatgacatggagcacatcttcttgaatgccaccaggagccaaaagctggtcactctcagcaacacactgcaccaggagttgcttagctatgttgatgtcacccaggtgtccctgcgcagcttccggcagtacttggaggagagtctgggcaaactccgctactcaaatattgagttcatcaaacactgcagattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccacagtgaccacagaagaactcctcagcttcgtccaaacttggaaggaaaaactgagccagaggattcagtaccttaactgcagcctggacagggtgtccatgactgaactggtctttaccaacaccatcctgaaggaccaggaggaagacagtgacatcctgacatcttcagaagcccttgaagaggaggccaagctggacgtggtcacccctgagtccttcacccagctgagccgcgtggggaagcccctgattgaggacccagctgtggatgtgatcaggaagctcctgcaacttcccaacacaaaatggccaacccaccattgtgacaaagatccgtcccagacaggtagaggcgcatgggcctgtgggtctcggggcagcagtgaggcaggggctggtggtgctgtgtgctcacctcctgtcctctgctcctgtcctgggccctcgtcacccaaaggcttcaagcgacatcggtgccagccagaaaactctgggaagaaggctgtacccagtgccagtgctacctctgcaggcagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacaga

SEQ ID NO: 3398 - DNA, 689 bp, Homo sapiens
  ENST00000528678
aagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacagctggtcactctcagcaacacactgcaccaggagttgcttagctatgttgatgtcacccaggtgtccctgcgcagcttccggcagtacttggagg

SEQ ID NO: 3399 - DNA, 562 bp, Homo sapiens
  ENST00000530011
taagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgagccgagcttttgcttcatcaagagcagttggacagccactgtgctggggtgaccgagacgctgaagaagaagcggctgatgttctgccagttccaagaagagcaaaacgtgaggagcaaaaacttccgccttaagatctatgacatggagcacatcttcttgaatgccaccaggagccaaaagctggtcactctcagcaacacactgcaccaggagttgcttagctatgttgatgtcacccaggtgtccctgcgcagcttccggcagtacttggaggagagtctgggcaaactccgctactcaaatattgagttcatcaaacactgca

SEQ ID NO: 3400 - DNA, 614 bp, Homo sapiens
  ENST00000471314
gtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccgtaagtgttcaatagattctgcatgtgaataataaagatatatcatgctaaagtcataaatgtgaaataaatttacctgtgtgtataggatttctccagcacaaggttggcggggtggggggacatctctgagccttcctacttaacccctgtttcatggaatgaagaaaggaacaaaagagaaagcagccactgttcacctccaacccctcccaggcaagcatggagcagcgtctagtgttgggggaggcctgagtctggcttcctctgacctcactcccttgggatgtcaccaggtgtc

SEQ ID NO: 3401 - DNA, 479 bp, Homo sapiens
  ENST00000527182
aggggctggtggtgctgtgtgctcacctcctgtcctctgctcctgtcctgggccctcgtcacccaaaggcttcaagcgacatcggtgccagccagaaaactctgggaagaaggctgtacccagtgccagtgctacctctgcaggcaggggcagcaaatgtgactcagctgaggggaaaaatcagaaaggggaaaggcaggtccaagcagaggaggggtgagaggagatagcaaggtcaagtgctttcccccatttctcttttcctttattgtaactccagtgattaaaacaaaagctgttcaacttagtatagcttcattgcaagcaaacaagcaaaattccaaggtcagaaaacaaaaagccttcggagaaagtcaagcaccacaaaggagctcccactcccactatgtcagagatccccccagacagcggccccctctcatcagccctctcaccctggagacctcgtctctgggggt

SEQ ID NO: 3402 - DNA, 740 bp, Homo sapiens
  ENST00000483504
gattggttaagcttacatttcattttcctagactatgaccattcattctgagttacgtttgttttctagctagaaactccaggcactggaaccgtgtcagcctgatggcctcctgtttatgatcttaaacacctggtggcctttacagtctgctgggagagatggaggttaatcagccagtcacacaaatcaatcccaaatccacctgattagcatgtcataaggctgagggggcattaatccaagatcattaaagccaggtggtcagaaattgcagctgagctggggtctgaggaagggcaggaacaaatacaaccaagaagagaagaaagttagctgctgttatggagtggaatcagagtgtgcagaggtcctggggcagcagtgagtaatttcaaggagtgtcacggccaaaacagagcacttggaaagttctgttcatgtggttttgtccatgtttgtgtgtctagaccaggcccctcagggatctgtctcgtgtgtgttgcagggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggaga

SEQ ID NO: 3403 - DNA, 7884 bp, Homo sapiens
  ENST00000526038
gggagacctagaatcaaggcaatagttgaaataatggatgagaacttgcccaaaatgccaagagacacagtgcattttaaatgagatgagaagtccgcagagtatataggagaagccctttgaatttatttaagcctttattttatgttatgttatgttatgttatgttatgttatgttatgttatgttatgttatgttagaaagagggtcttgctctgtggcccaggctagagtgtggtgcaattatagttcaccatagcctcaaactcctgggcttaagcaatcctcccacttcagcctcctgagtagctggcatgtaccaccatgcctggctaatgtttaaatatttttttagagacagggtcttgcccaagctggtcttgaactcctggcctcaagcaatcctcccacctcagcctcccaaagtgctgggattacaggtgtaagccactgcagctggctaaccctgtattttctatactggtttgacctcaggacctcttttgatggaatagctcttaccacgttggagaccaagattttctctttgggaagctgctttgggcctttgttgtagagatcgcctctgcaagttgattctaatctgttccctcccttggcctcttacccgcacttctggcagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggtcagtgataccattgattcgccagtccaggcatgctccaaatatagcccgatggacagccactgacagtgccaggtgcagccctttcttggtatcttgcccaaagcaggcatgatcgtggttgggttttgtaggtaaaaatggccattattggctgttttaacttgtatacttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccgtgttagccaggatggtctcgatctcctgacctcatgatccacccgcctcggcctcccaaagtgctgggattacaggcgtgagccaccgcgcccggcctaacttgtatactttttgacttctaaattaattaattacaaaattactgacgataacttttatttagtgatccatgtctagttttatttcctcttctgtgaattgtctgtgtgtgtcccttggccgtttctgaatcatttattatgtttaaaccagatcacatcttgggagaggcctcctggctgagggccagatgctggttacttggacacagtggatataatggcttgggtccccagatctccctgcagagttcacccatcccctcttcagctggccttggagggatgatcctctcctagcagcactgtgctcaccatgttttttccaggaatgtaccagaaggaatggccaggttttcataaccaacttggccaccttcaccgagaagttcctactgcagttggatgaggtggtcaccattgacgatgtccaggttgcaagtaagaggcaccaccagccttgtgtcatggccctggggggctggtgagggctaggttgggcaggggtctgctttccccaactctatcaaagtgaaaacaagtgatccattgaggggactgattaatttttgttttccttaaaaataattttttgattaaaaagcaaatgccagatggctcaacgtttatatataaaaaatgaaaccctattaagtaaacactcccatactcttggggttagggataccttttctaagtatgacaggagagctagaagccatagagggaatggctggctctttgtagccaaaaaaatcccgaaaaatgtcaaaagatggaaagacaaaccacaaactggaaaagtattcctcacaacttacagatcagagaaagggttaatatccttgtggtacaaagaactctcacaggtcaaatttttaaagagacgaaggacaaacacatgctcttcaaaagagaagcagttcatatggctagtcactgtaaaaaatgctcaacttcactgatgatgaaaaatgaaaatctaagcattatttagatatcatttctcaccaatagcctggcaaagtttttacatttggtaacaacgtaaaagaatgtcaagaaacagagactctgcagagactcttggtagagcgtacatggataccgctgtcatagggaacaatttgtcagtccctgtcaaaattctgagtgtgtagacgtttggcctagcacgtctaattctaggaatttatctgagagaaatacttggacactttttcaaaggtatatgttcaaaaatgttcacagcactgtttgaaatggcaaagaattggaagcaacactaacattgatatacagaaaattcaatgggccaggcacagtggcccacacctgcagtcccagcacttgagaggctgaggtgggtggatctcttgagcccaggagtttgagacaagcctgggcaacatgacaaaacctcatctctactaaaaatttaaagattagctcggtgtggtggtgtgcacgtgtagttccagctcctagaggtggagggcggttgggagggtgctgaggtgggaggattgcttaagtctttaagtcgagactgctgtgagctttgatcataccactgcactccagcctggtgagagagcaagaccgtgactcaaaaataacgaaaattggatgcataaatgagggtgccagatgtgcaggtaaataccacacagctgttaaagtaggtctgcatgtgctgacatggaaagacatgaaggagggctgttgtgtgaaaaaacaaatggacaaacaggacatgtctgtgatcccatcttttaaaacacatgcatgatatcaacatgcatactcacatctgtttaaatgaatctgtgtgagagacagagacagagagacaggtaccaaactgctgatgatcacctctgctgggtgggactgagagagatccctaaaaccttttttctcatcatgaagtgatgtttacatttttaataatgtgcatattacttttataaatataagattaaaatcatacattaaatgttatccatttatcactgatctataaagtaattaaaatgcatcctttttatttgtaaaggtttttaattacaaaaacaataaatgttcattccagtaaaacaagaaaatcagtataaaccaagaagcaagtgaagaacacagtccttccgccctgaaagcagcgccctttgcacttgctgttcatcctgccaggcctttccctttgggcacaggcctgtgtgtcagggtggctggggaagattacagggcttgggcgcttttgcgacctgatttccctgcaggtgaaccttggctgggctggccagtcaacactcctcctcttcagcattttcagttgctgcacaccataatgtaataagcattgtaacttactaattagtccctttgctattgaactttggaccatttccaatttcccactcctgtaattgtgctgaagagaatctctgcatccatgcatctctagagcaacagactcctagaagtgcgatgtctggatcaaagtgtgtacagatttttgaagtgttggtcacttttctctatcagaggtctctgtcaaaggtgagccttgtttgggaaatcagcgccttgcagagatgctggggtcgagaccccagggagaacaggcaggtgagctggtagtggagcagatcacagtgccttgcaaggaacccctgagccaggaagactccctgcaccaggccctaggaggcctctgcctactctgcaactcggcttctgagccaggccaccgggccctgccattcatggcagaggagtgtacatgttacctgctggctctctgcacacagagccccccaccccctcgcccctgatctagaaagaacatcagagcatcaaagattggattattgagctagatagtcaagggacaaccttgaacgtgtttgttccaggggaggttcttagttcggaacccatatgagctagcctaagccaaagaagtctctatgaaccatatccggggactcatggaaactgcagcaacgtcagagcatcaggcttgggtttggagctgggaacagcacccacaccaccgcttagattcctccatccatgaccccctgcccctgtcaccaccccgagctgtgtggctggtgcattcagcttctccatggagagggctcagcctgccataactccaagtgggaggaggggtgccagtcctcccttttctaagtgtaatgccaggggaaatccctcgatctcaggctgtcggtgaggctgcagtcactagcctgtcttttgcctctagggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctggtgagacagggtggagtgggcgtgtcccagggagcacagctcaggtcggctgccttgggaagggggagcttcccatcacccggcacccaacatttggctggtgcagcaggcaacacatgtcagcacaccccagagctgcaggtctcaacactcaggacagtcaccattcacaggcacgaggacattaatgtgggtctgaggcgtgatcccaatgctgtgggagcccagctgagggacatcccacccagattaggggtgaaggctttccaaaggcacagtagtgtcacagctagggaacattgtcaccaggcacggaagcaatggtagccgtaggctcaggggggacacagcagcaggagcagtcacagctcctgagaacttactgggaagtacttactgagagcttctgctcttgacatgaggcatctcactgaatcctcctaacaactccacaagggaggtaaaattattatcatttcattgatgaggacactgaggcttaaagaaacttgtcccttctatgccactacagagtggcagagccaggatttgatcccagtgcctgtcagaccccctggggacagcctgatgaggaggctacacccagttgccacttgagggacctcttggctttgaagatctgtggacctttggtcctgatgtccagagagaaaccttgtcctgcccagagaccagctggcccccttactgggagaggctgaagtgcccagggtcagccctcccccagcttcccctccaagccccaggcagagggtgcagttcggcctgctgagttcagtgagggtgggaggcctggaaggcccagcctaccaaaaaatcgggagccctgagctcccgagaggccacagtgtgggacagagctcaggaaggagtgctgagcctagagtcagatagacacaggtcctagtccctgctcagcctccttctagctgggtgaccccaggccaggctctgagcctcagttttcctgtcttgtaaaatggggaaaacaactaggactacctggtttctacctgagaagtgacttggagaactcttgccagtgcctggaatgggttaaaaaccacctgccagcaagttacagcattgccctaggggagagggtccagatgtctctcctcatgtggacccctcctgctaccttccttctagaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagactccttccctgtccatctacctgcctacctactttccgtccatccctccctcccttcatccctccacccctgctctgtgccgggcactgtagctttaccagcgaacaggacacagcatggtccctgcccacgtggagccctcttcccatgaggaaggcaagcatgaaaggggaattccacgtggttagcagggagggtgagtaccaggaatcagtcacttcaaataggcaccagagcttcaaaggacatcacctccaaacagcatgctgggcagggcacgtcatcttgaaaaatgaaataaaggtcatgggaaaatgatattttaatttaacagaataaacaagtatgggttataattgcaactctgcactggttcctagacccaacaaataactaatccaatgttgattggtatttgtgccacaatttgtctgagcaaattgcaatattttggaaaaaaaaaaatcttccaggctcctttagtcctgtgttgcccagatcattctcttggagtcctccagcctgccagtctcttgttcgtcaactctcttcttcaattacatggcgtgagcgtacagccttcatttgtcggtagctgtgtgtgtcatctggacaggtttcctcagccatagacctaggaggccccagctcccaaatttccagcccctgaaagctgtgtgaccctccaagtgcagttccctcacctggggacactcactctgctctcctggtttgctccacccagtgaggccctgcttggttagcttggttagcttggtggcctttgtgcactgaagccaggagagtgaggagtccccttccatcaaggcaaaagcaatctcctgttcttttctgtgctccccccacccccaccccaatgtgctacctttcattgcttattattccgaaaggaatatatgcgcattgtagaaaaaagaatttatgaaaccagcaaaaggataactttaaaatcctgagccgggcgcggtggctcacgcctgtaatcctagcactttgggaggccaaggcgagcagatcatctgagctcaggagttcggggccagctgaggcaacatgacgaaaccccatatctactaaaaatacaaaaagttagccaggcatggtggcacacacctgtaatcccagctactggggaggctgaggcatgagaatcgctttaacctgggaggtggaggttgcagtgagccaagatcatgccacttcactctggcctgagcaacagaatgagactctgtctcaaataaacgaataaataaataataaaatcctggaatctagagacagtcactgtccatagcatctttccatgtatgtgagttatttttataaaatggaatcataacatgcattaggttccataaactgcttggtaaatgttaactggataaaccctatgccatatccttcagtattcatttacatcattggttttcatacttttctgactctgacccactgtataaacatgttctaaacacacggtccttgcacacatacacaacttgagaccaacaggtcacaggacagcacttaaccttactagaaaggctgctttctaatattttctccc

SEQ ID NO: 3404 - DNA, 589 bp, Homo sapiens
  ENST00000534189
gtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaagtaagaggcaccaccagccttgtgtcatggccctggggggctggtgagggctaggttgggcaggggtctgctttccccaactctatcaaagtgaaaacaagtgatccattgaggggactgattaatttttgttttccttaaaaataattttttgattaaaaagcaaatgccagatggctcaacgtttatatataaaaaatgaaaccctattaagtaaacactcccatactcttggggttagggataccttttctaagtatgacaggaga

SEQ ID NO: 3405 - DNA, 665 bp, Homo sapiens
  ENST00000530551
tctagttttatttcctcttctgtgaattgtctgtgtgtgtcccttggccgtttctgaatcatttattatgtttaaaccagatcacatcttgggagaggcctcctggctgagggccagatgctggttacttggacacagtggatataatggcttgggtccccagatctccctgcagagttcacccatcccctcttcagctggccttggagggatgatcctctcctagcagcactgtgctcaccatgttttttccaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatc

SEQ ID NO: 3406 - DNA, 3084 bp, Homo sapiens
  ENST00000487976
aatgccagatggctcaacgtttatatataaaaaatgaaaccctattaagtaaacactcccatactcttggggttagggataccttttctaagtatgacaggagagctagaagccatagagggaatggctggctctttgtagccaaaaaaatcccgaaaaatgtcaaaagatggaaagacaaaccacaaactggaaaagtattcctcacaacttacagatcagagaaagggttaatatccttgtggtacaaagaactctcacaggtcaaatttttaaagagacgaaggacaaacacatgctcttcaaaagagaagcagttcatatggctagtcactgtaaaaaatgctcaacttcactgatgatgaaaaatgaaaatctaagcattatttagatatcatttctcaccaatagcctggcaaagtttttacatttggtaacaacgtaaaagaatgtcaagaaacagagactctgcagagactcttggtagagcgtacatggataccgctgtcatagggaacaatttgtcagtccctgtcaaaattctgagtgtgtagacgtttggcctagcacgtctaattctaggaatttatctgagagaaatacttggacactttttcaaaggtatatgttcaaaaatgttcacagcactgtttgaaatggcaaagaattggaagcaacactaacattgatatacagaaaattcaatgggccaggcacagtggcccacacctgcagtcccagcacttgagaggctgaggtgggtggatctcttgagcccaggagtttgagacaagcctgggcaacatgacaaaacctcatctctactaaaaatttaaagattagctcggtgtggtggtgtgcacgtgtagttccagctcctagaggtggagggcggttgggagggtgctgaggtgggaggattgcttaagtctttaagtcgagactgctgtgagctttgatcataccactgcactccagcctggtgagagagcaagaccgtgactcaaaaataacgaaaattggatgcataaatgagggtgccagatgtgcaggtaaataccacacagctgttaaagtaggtctgcatgtgctgacatggaaagacatgaaggagggctgttgtgtgaaaaaacaaatggacaaacaggacatgtctgtgatcccatcttttaaaacacatgcatgatatcaacatgcatactcacatctgtttaaatgaatctgtgtgagagacagagacagagagacaggtaccaaactgctgatgatcacctctgctgggtgggactgagagagatccctaaaaccttttttctcatcatgaagtgatgtttacatttttaataatgtgcatattacttttataaatataagattaaaatcatacattaaatgttatccatttatcactgatctataaagtaattaaaatgcatcctttttatttgtaaaggtttttaattacaaaaacaataaatgttcattccagtaaaacaagaaaatcagtataaaccaagaagcaagtgaagaacacagtccttccgccctgaaagcagcgccctttgcacttgctgttcatcctgccaggcctttccctttgggcacaggcctgtgtgtcagggtggctggggaagattacagggcttgggcgcttttgcgacctgatttccctgcaggtgaaccttggctgggctggccagtcaacactcctcctcttcagcattttcagttgctgcacaccataatgtaataagcattgtaacttactaattagtccctttgctattgaactttggaccatttccaatttcccactcctgtaattgtgctgaagagaatctctgcatccatgcatctctagagcaacagactcctagaagtgcgatgtctggatcaaagtgtgtacagatttttgaagtgttggtcacttttctctatcagaggtctctgtcaaaggtgagccttgtttgggaaatcagcgccttgcagagatgctggggtcgagaccccagggagaacaggcaggtgagctggtagtggagcagatcacagtgccttgcaaggaacccctgagccaggaagactccctgcaccaggccctaggaggcctctgcctactctgcaactcggcttctgagccaggccaccgggccctgccattcatggcagaggagtgtacatgttacctgctggctctctgcacacagagccccccaccccctcgcccctgatctagaaagaacatcagagcatcaaagattggattattgagctagatagtcaagggacaaccttgaacgtgtttgttccaggggaggttcttagttcggaacccatatgagctagcctaagccaaagaagtctctatgaaccatatccggggactcatggaaactgcagcaacgtcagagcatcaggcttgggtttggagctgggaacagcacccacaccaccgcttagattcctccatccatgaccccctgcccctgtcaccaccccgagctgtgtggctggtgcattcagcttctccatggagagggctcagcctgccataactccaagtgggaggaggggtgccagtcctcccttttctaagtgtaatgccaggggaaatccctcgatctcaggctgtcggtgaggctgcagtcactagcctgtcttttgcctctagggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacaga

SEQ ID NO: 3407 - DNA, 574 bp, Homo sapiens
  ENST00000596161
agttgaaccgctcgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggctgtgagtgtgcctgcctggggtgggctcacctttcctctcctgggatcagcttctcccagaatatcaggccaccctgaatcctgcccacctgcctcttctttgtcaccagaaactctccagtgtggggaggggtgtaggtcttgttgctcaagccagagacactggagtcgggtagaattgcagagcttaggtgcattgccctggggctgggcaagcggtcagacctcaggagagacttttctccccacccagtcattgaagatttgactcacaagacagggaacttcaaacagttcaacatcttctgtcatatgctggagtcagccctcactcaggtagggcccgggttggcgggttggggtgggaggggggttctg

SEQ ID NO: 3408 - DNA, 1817 bp, Homo sapiens
  ENST00000595358
agttgaaccgctcgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcaggtgtcgcgcctggcgtccgagaagcgggagctggaggcgcagctgggccgatcgcgcgaggaggcgctggccgggcgcgcggcacgccaggaggccgaggcgctgcgcgggctggtgcgcgggctggagctggagctgcggcaggagcgcggcctcgggcacagggtggccggccgtcgcggccaggactgccgccgtctggccaaggagctcgaggaggcgaaggcatcggagcggagcctgcgcgcccggctgaagacgctgaccagcgagctggcattgtacaagagggggaggcggactccgccggtgcagccgcccccgacgcgggaggaccgggcctcatcgtcccgggagcgctccgcgtcgcgaggccgcggcgccgcgcgctcctcatcccgggagagcggccgcgggagccggggtcggggccgccctgcgcgcccctcgccctcgcccacaggtggtcgcgcgctccgcttcgaccccacggcctttgtgaaagccaaggaaaggaagcagagagagatccagatgaagcagcagcagcggaaccgcttaggcagtgggggaagcggggacggtccgtccgtctcctggtctcgccagacccagccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtggagaaggggtactacccctccatcccccacccacttgctgggtatggtgtggggggtggggccagggtggcctccagccctgcccagtccctgccctggccccgtccctcctgctgcccctggggtctcaggtgtgtgaggccctgaccctgccctctccccaggcagtgcatgctgggagggaggatgtgtgcattttgtaaataaacatatttgccctgggga

SEQ ID NO: 3409 - DNA, 433 bp, Homo sapiens
  ENST00000594672
gaaccgctcgcgaggagggttgctagtggagaagcctggatctctgccctgaactccagactcatatcatggccgactcttctctctttggaagttcatctgacattcagacataaacttgtcccaaaccaatcttgcgatttcttcctttcaacctccaaacccagttgatgggacattcatcctgccagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcag

SEQ ID NO: 3410 - DNA, 800 bp, Homo sapiens
  ENST00000596687
cgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggctagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcaggtgtcgcgcctggcgtccgagaagcgggagctggaggcgcagctgggccgatcgcgcgaggaggcgctggccgggcgcgcggcacgccaggaggccgaggcgctgcgcgggctggtgcgcgggctggagctggagctgcggcaggagcgcggcctcgggcacagggtggccggccgtcgcggccaggactgccgccgtctggccaaggagctcgaggaggcgaaggcatcggagcggagcctgcgcgcccggctgaagacgctgaccagcgagctggcattgtacaagaggggg

SEQ ID NO: 3411 - DNA, 849 bp, Homo sapiens
  ENST00000599044
agcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcaggtgtcgcgcctggcgtccgagaagcgggagctggaggcgcagctgggccgatcgcgcgaggaggcgctggccgggcgcgcggcacgccaggaggccgaggcgctgcgcgggctggtgcgcgggctggagctggagctgcggcaggagcgcggcctcgggcacagggtggccggccgtcgcggccaggactgccgccgtctggccaaggaggtgagcagcgggggcccggggcggccagcgaggcgcggacctcggcctcagcctggacctccgcgcccctctcc

SEQ ID NO: 3412 - DNA, 1017 bp, Homo sapiens
  ENST00000594087
agcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcagcagcagcagcggaaccgcttaggcagtgggggaagcggggacggtccgtccgtctcctggtctcgccagacccagccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtgg

SEQ ID NO: 3413 - DNA, 291 bp, Homo sapiens
  ENST00000601763
cggtcataacgtggagaaggggtactacccctccatcccccacccacttgctgggtgaagaaacgaggctcagagagagaaggtgacgtgacatggaaaggggattcagaacgttagaaccagattcggaatcctaaaagctgagggccagacagcggctgcttctgtatgtggtgatgtggacccgaggctcgggccttcgtgacctcatgggaacacttaggatcagagcgcctgagtcttggaaacaaaatgttgaagttggagtctttgataaaatcttgaactgga

SEQ ID NO: 3414 - DNA, 1282 bp, Homo sapiens
  ENST00000536603
ttcgtcagttgaaccgctcgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcagcagcagcagcggaaccgcttaggcagtgggggaagcggggacggtccgtccgtctcctggtctcgccagacccagccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtggagaaggggtactacccctccatcccccacccacttgctgggtatggtgtggggggtggggccagggtggcctccagccctgcccagtccctgccctggccccgtccctcctgctgcccctggggtctcaggtgtgtgaggccctgaccctgccctctccccaggcagtgcatgctgggagggaggatgtgtgcattttgtaaataaacatatttgccctgggg

SEQ ID NO: 3415 - DNA, 12430 bp, Homo sapiens
  ENST00000206423
gaacagactggaagagaagttaccccgatgacttggtttggaaggggttaaggcaccagtcatcctcttctaaagtgatttatgatgatgtgtggagtttaaaaactttaccccaccccaaagaacagccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctattcatgagttattattgaaacctcaaatcataaagacatttaaaagaattgtttttctaactggaggggctctagtgctaaataatagtactgaaaattgatattattttccttttcttatatgaaggaccttatttggcatataaaattttataaaatatgtatttaaagctttttcttattttttgtattaattggtaagtgaaaactctgttaaagatcacaccacaatgttttcaagaaacatctgaaaagataaaacaaagaacaaataacttataatacttacttaaattgacactttttgaaatgccagtctgaaaataattaagatatctctgctttgtatgagtttcttttatgaaacttgataccacgggagtccagtaatattggccacaaaagccagagaaagtaccaagcccagctttgttatcatagccacttcctgccctgcttctgttatttttagtgttttttcagatataaatcggggtccaggaaatcctcaccagaatctggcactgcagccaaaggcgatacttccagagttctagtaggctgctatggaatttctggcatgaaaattcttgacccctcacactttaccccctgtacagcacaggcataccatggagatattacaggatcagttccagaccaccataataaagtggatatcgcaataaagtgagtcacacaaaatttttggtttctcagtgcatataaaagttatgtttacactctttagtagtctattaagtgtataatagctttatgtccaaaaaatgtacatgttttattttaaaaatactttattgctaaaaattgctaatgatcataatctttttgcattgatgttgatggctgctgaatgatcagggtggtggttactgaaggttgggggtgatggtggcaatttcttaaaataagacagcaatgaagtttgccacttcgattgactttttcttcatgaaagatttctctgcagcatgtgatgctgtatgatagcattttaccagtagtacaacttcttttgaaattggagccaatcctctcaaaccctgttgctgctttattaatgaaatttatgtaatgttgtaaatcctttgttgtcatttcaataatgtacatagcaacttacgcgagtagattccatctcaagaaatcactttcttcgttcattcataagaagcaagtcttcatctattaaacttttgtaatgagattgcagcaattcagtcacatcttcaggctccacttctaattccagttctcttgctatttccactatgtctatagcagagcttcctccaatgaagtcttgggcctcttaaaatcatccatgagggatggaatcagtttccgaactcattgatcttcctattttgaccttctcccatgaatcacgatgttcttaacagcatctagaatggtgaatcctttccaggtttttaatttgctttgcccagatccattagcgggatcacaatctgtgacagttatagtcttacgaaaagtgcaaatgactccttgattcctgtgctgcacaataggtattgtgttagcaggcacgaaaatattaatctccttgtatatctctatccaagttcttgggtgactgggtatattgtcagtgaacagctatatatatatatattatagtggtctggaactgatcatttatatatatattttatatacatatataaaatatataatatatattatatatatatatatttttttcgagatggagtctcgctctgtcacccaggctggagtgcagtggtgcgatcttggctcactgcaacctctgcctccggggttcaagtgattctcctgcctcagacccctgagtagctggatttacaggcgcccaccactacacccagcttatttttgtatttttagtagagatggggtttcaccatgttagtcagggtggtctcgaactactgactttggcctcggcctcccaaagtgctgggattacaggcatgagccactgcgcccggcccgaacagcaatatttttaaaagattctttttttttctgagcagtaagactcaaaaagtgagcttaaaatgtccagtaaaccatgctgtccatagacatgctgtcattcaggctttgttgctccatttatagagcacaggcagattagatttagcataattctgaaaagtcgtaggatttggggaaatggtaaatgagcattgatttcaacttaaaatcaccagctgcgttaacttctaacaaggagtaagcctgttggttgaagctttgaagtgaggcattgactactcctctctagatacgtaagtctgagatggcatcttcttccaatataaggctgtttcatctcttttgaaaatctattgtttagtgtagccactttcattaattatcttaactagatcttctggataacttactgcagcttctacatcaacatttgctgctttactttgcacttttatggatgcacaaggcttcttttcttcaaactcatgaaccagactctgctaccttcaaactttttttctgaagcttcctcacctccctttagctttcatagaattgaagagagttagggccttgctctgaactaggctttggcttaagggaattttgtggctggcttgatcttctattcagatgactcaaagtttctccatatcagcagtaaggctgttttacttttttatcattcatgcattcacaaagtagcacttttaatttccttcaagaacttttcctttgcatttacaacttggttgtttggcataagaggcttagctttcagcctgtctcagcttttgacacaccttcctcactaagcttattcatttctagcttttgatttaaagtgaaagattgcaacttcctctcacttgaaatacctggaggctattttagggttattaattgatctactttcaatattgtgtctcagggactaaggaggcctgagaagaaggagaaagattggagaaaggttggttgttggagcaatcagaacatacacacatttattaagtttactgtgttatataagtgtggttcatggtgcccccagtaattataatagcaacatcaaagatcgttgactacagattttaataacagagataataatgaaacagtgtgaaatatggcaagaattaccaaaatgtgacacagagacataaagtgagtacatactattgcaaaaatgatgtcaacagacttccttgatgcagggttgccacaaaccttcaatttgtaaaaaatgcagtatctgagaagtataataaaataagatgtgcctgtacttacttgctaatggacctattaccatactggcatcttataaaaaaaattacaaggaaggagattatatccagggattctttttgttttcaaggcaaaggttaccaagttacaatggaccaaagtagctggaatgcaaaggagtataatccttgtctttgaaaaaagagcatttgtttcaatcatatggcatatcaaagtaaactttctcccttcctccctcctttcgttgctgctgcttcttttttttctctttttttttttctttttttggagagggtctcactctgtcacccaggctgcagtgcagtagtgcaatcttggctcactgcaaactcagcttccctcaaacaatcctcccacctcagcatcccaagttagctgggaccacagccatgctccaccatgcccagccatccttgcttctttactacatttcttttttcaacaaatatttatcaagtaatattgtcaagtaatatttatgagcttcccctcagataggcatttagcatcatgatggcaccatcctctaacaataatgggaaggctattttccactgttattaatcattaattctccaaatcattttagtattattattaattctaataagtacagagattaataaatgcattcaaaccacatgtgaatatttgctataggtttatctgtgcctactgtatgttcagatttttctttatatctgaactttgttataaataaatgacagtaaaaatggaatttatagttcaatgaacttgacaaatcacttattctgccattcattttccataaagaccattcattcttccttgttttacaggtaactgagctccagaaagctcaagtgactttagaactcagttcttagtgtgtgaattatgctcccatctcatccctcttccttgatggagcactttcctcctcattttttcttggatagtctgtacaagctgcctgaggtgtgcaggaaagtgagccacgtcgaagtgtactgcttttaaatttttgccaggatgaagcatagcccaaagttgccaataaaaatggatttctttacctttctgaaattgtgtgatgacaatttctaagtaaaggacccaaatcatgtcaacttcaggaaatataataatgagggagccaggagcagtgaggggctcacacctgtaatcccagcactttgggaggccaaggtgagcgggtcgcttgagcccaggacttcgagaccagcctgggcaacacggcaaaaccctgtctctacaaaaaaatacaaaaaattagctgggtaaggtggtgtgtgtctgtggtcccagctattcaggaggctgaagtgagagaatcgcttgagcctaggaggtcgaggcttcagtgtgccgtgatcgtgccacagcactccatcatcatcatcctgggtgacaaagtgagaccctgtctccccaccaaaaaaaagagggagtttcatctcccaagaaaatgaattagataggaataatagaaaatttactctcagaataatagggttctagctcctgcaaccaaaaaaagatagttcttttttacaacctgagattactttttcaagcatttctccagttccactggcattgaaataatagttagcaatgcatctgagcttttcttcctctaatgagcaggcagagaagtcatagatcatcatttggaggactataaaataagacatagcttagcaaaaggaccaaaatacattcagaggaggatgctattggtgaatgtcctcaaagcctataatctggaaaaatacaaggcatatctctgaaactgtgaggattagcaaactagctaacctgaatctctgtcttctggtagtataaactaggtagtttcaaatctgagtagtttctccataaaagcatttcttcccaaacgtttcttaccaaactcccaaataaatgagaaaaataaaatacagttttataatttttgagaaagattatgggattatggtatttaaaaagaaaagcattctgtagagttggggaaatctggaagactcttgaggacatagctttgccgaaattgctggttgtcacaagactcttcaaaaactacttttcatcagacatctcccagggctctgaggtgaatattaattcagcagaaagatccttttctgctacataggcaggaggtccagacacaggggagtgggtgcaacccagctggtcccattttctgtaatataattaacaatgaagctcatactttctcaacttctagaagcctggaggatggaagcagcccgagagtagggtgaatgatggcctcagtgggcccttcttaatgtgtctcagtactgaatgtgtggagattgtagaaaaatagaaggcccttggaaaaaacctctgttcgtttctctgttcgtttcgctccctgatctccctgccggattgcttttctttcctttctcttccttggctgtcctttacctcatggtgtggggtgtgcagatagcaggttgtggcttggtgagtgctcttcacttcaggtcaaggtgaggcacagttaacatgctaactactttcctcagttctctctgagttgtgtaaagctcccgatgccagacttcctcttaattttgcacattattaaagtccaaagagttaagatttggtgatgaggggcaaagggccagctgtcacagaaatcaatgaaatgatacacagaaatgggtatcatgaaaaggccactggacttgggaaaactgggtgcctgtccttgccctgccatgtacttacctgtgtgactggaggtgagatgttttacctatgggcctcagtttctcattacaaaatgacagagaagactagatacctaagttcctaagtttgtgacatttgtgaatttttcttggccctctgtgagtagagtgctaaatttagaggcttcctgtggttgaactgatgtccaattctcagggaacccagacttctcagttcagaacccagttccagatttttgtgggaatagggaaaggtattaaataactccattgaattctttcctgcataatgccctgctgtggctgagactcaatgaggtcatcacctccaacacacagaacccctcatcatctccttacagccagactggagcttccaaggacatcaggttggcaaggattgtgagtaccctaaacatctaaagaggccctctaataagggacatatttgttcttcaacagtttcctaacttgagaccacaaatgcgtaatctctctaatatcctaaagcttggacaaactgggcagcccctgagcagaccgcacagagcttaaatgtcagtgctttccttccagaaagaaaaagaatggtcctacacctcccaatccatgggctgatacatatgccaagggagccggatgaagaagtgggtgattttaaatagctaagactgcccatgggcaaacgttctttggcttttctcctctgcaataagtataccttcctctctcctggtccttttctcctttcccaggcccctctatcaataataattctggctctcagatgactacagttgattaggtggaactgataggataaaggtgacacccttcccaaggctatctataatgcaaaaagatatccaagaaaaagagaggtagggaacaccttgggaaaccatttctggaagacagccagtccctgctgtagacaagcctcattttccttcccccaaatgttaaagagtaaattcctcctgtagccttagctctcttttctatctttggcttgctttttatgaactatctttagagtgccaaattagaacagggtaggcagaggcaggaatatgcccaaatttgggaagacctggttgggaatagtcgaaagccttgatatgtgcaaagaaagaaccatttgatcaacccagttcttaatacaggatactaacttaaaatttagactcaagttatacgataattcaaacatttattgtatttatactattctatatgtacttttccaggaaccaggaatacaaaactgacatttctctgtacagaggctcagactagtagagaacagttaggtacgccgttaattataaactaatatgtatcatcaattatgggtttttatgggggtttggcaggtggaagggaccagggagagatgatgagtgatgatggttatgtagtctttaggaggatgcaattataacattgctcttcctttcacgcaccacatgatttagcaagtacttcatattggctccaccattaacatggtcaatggcttctggatactcacagttcaggcacagtttctcctgaagattttttacctctcccatctttaagaaattgtctggatgtccatgaaagatgctgacacttgtattaattcattaaaaaacaccaccccctccctgaaataaactaaaaagtaatgaattcatagaaaaaaatttcaccaagattgaaactagagaatatacctagacttgcactttgagctttgagaaatgtgtacctattcaccattccaacgtgaagaagctctgcagtaggaaaaataattaacacacttatagtctactgcccatgtaaggatcagctccggctaagaggccaaagatgggtgacatcgttatgctctgcctttattttttctttcttacccacttagcttcctaattggaggaaggaggcgtggtaaaggtatatgaagactatggtttaattagaccagaaaacactgtcataatctctggggtcatcagaatgtccagttttgtctttgggccaagataagggcagtgggatttatgatgtgttgtttatagtctgaaactactctggtgatcaccagggtcagtttctttaatgatggtttccaactggcctaatacattaagtaagactggctgataacatgaccagacagacataaagaccctgttgggaatgacattgaactctcaaagtcaagatttcttacacaaatctatcagctggagaaaatgaaggcagtgtggtatatgtgtgcaaataaggacattatgaagcttaaatatggaatgtctcttggacccccgatgtcatctgtattctctttttcttcttgtactatatcctttgcctgtaaataaaaggtttatttgatta

SEQ ID NO: 3416 - DNA, 3557 bp, Homo sapiens
  ENST00000439685
gagaattttctccttccaaagtacagtgtaagaacagactggaagagaagttaccccgatgacttggtttggaaggggttaaggcaccagtcatcctcttctaaagtgatttatgatgatgtgtggagtttaaaaactttaccccaccccaaagaacagccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaagtggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctattcatgagttattattgaaacctcaaatcataaagacatttaaaagaattgtttttctaactggaggggctctagtgctaaataatagtactgaaaattgatattattttccttttcttatatgaaggaccttatttggcatataaaattttataaaatatgta

SEQ ID NO: 3417 - DNA, 681 bp, Homo sapiens
  ENST00000479368
gaagttacaacagaaaaactacaggagtgtagcaatgcagtttaatggctttgagaagcatgggacagttctctgtttttttctttttttttttctgggcacagaaaaaaattgctagcctaagtcactctggtttcctacattggtttttattgtttgaagcagtaagcagtaatggtgtcctgctttttttttccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttacc

SEQ ID NO: 3418 - DNA, 781 bp, Homo sapiens
  ENST00000461431
cttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtac

SEQ ID NO: 3419 - DNA, 1010 bp, Homo sapiens
  ENST00000475181
agtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaagtggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgag

SEQ ID NO: 3420 - DNA, 626 bp, Homo sapiens
  ENST00000469554
agccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaaga

SEQ ID NO: 3421 - DNA, 560 bp, Homo sapiens
  ENST00000473959
aaaattatagtgatggccactggaggatggattagagaggatgagtctgttggctggaagaccaactggaacatattgccctggcttctgatttcatgacaaattggcatggtaatacttaatacttaacagttgcagaaaaatagaaagatctaaatggaggacttacaaaatatggagctcttaaataacggacttgaaattgagaattattacaagccattaatcattatagatctccccggaaatgaatgaatgagaatttatcattgctcttattaggtacgtgcctccaatacttcttcaggaggattttctgaagccccagtggctgctgttgtttgagtttggtttggagcaaaactgaggtagtcctaacatttctgggactgaatccaggcaagagaaagaagaaaaagaagaagaaaaagaggaggaaaaagcctggaaaacatattaatcccagtgcttttacgcccggaaacaaagagactaagccagactatgggggaaagggagataagaaggatcctggaactttaaagagggaaagagtgaga

SEQ ID NO: 3422 - DNA, 684 bp, Homo sapiens
  ENST00000480275
attaagatgctgaaatgtaacttgagggcaataagaaaactgttgaggaatttgccacaggaatgaaacactgatattttaggaaaattatagtgatggccactggaggatggattagagaggatgagtctgttggctggaagaccaactggaacatattgccctggcttctgatttcatgacaaattggcatggtaatacttaatacttaacagttgcagaaaaatagaaagatctaaatggaggacttacaaaatatggagctcttaaataacggacttgaaattgagaattattacaagccattaatcattatagatctccccggaaatgaatgaatgagaatttatcattgctcttattaggtacgtgcctccaatacttcttcaggaggattttctgaagccccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaag

SEQ ID NO: 3423 - DNA, 3982 bp, Homo sapiens
  ENST00000407595
gcgccgcggtgcccggcgcgccctccaagctaggagaggggagaagccgggggctgcagctgggcaagggggaggaaagtgcgtgtgcgtgcacgcctgtgtgcagggcagagagtgcggggggcgacagtctcggcttagggcggaggagagggcaggggaacggcggtgcagctcccccgctgtccccgaggatttcccgcggcagccccgggctccccagtgcccctcaccatggacttgcgcggagttgggacgggcctcggcagcagcaagcggctggctgccgggccctgggggagcgcgggcgcgcgcgcggggatggcgaggtaggatggccacccagcgcgacccccgccgccccaacccagcggcccctgggcggtgccgctgactcgccggagcgcacaggggtgtgggcggaggcggcctcgccgcgcccgcgccttcgggagtcgcctcgcctcttccacccacttgcacctgccaccccgcggataccatgtcgaaggcggccggaggcgcggcggcggctgcggcggcggcggaaagttgttccccagccccggccggctcgtccgcggccccgcccgcgccggtggaggacctgtccaaagtgtcggacgaggagctgctgcagtggagcaaggaggagctgatccgcagcctgcggcgcgccgaggcggagaaggtgagcgcgatgctggaccacagcaacctcatccgcgaggtgaaccgccgcctgcagctgcacctcggcgagatccgcggcctcaaggatatcaaccagaaactccaggaagacaaccaggaactgagggacctctgctgtttcctggatgatgaccggcagaaaggcaagagggtgtctcgggagtggcagagactgggtcgctacactgccggggtgatgcacaaggaagtggccttatacctgcagaagctgaaagacctggaggtgaagcaggaggaagtggtgaaggagaacatggagctcaaggagctctgtgtgctactagatgaggagaagggtgcaggctgcgcaggcagccgctgctccatcgacagccaggccagcctgtgccaactcacagcctccaccgcaccctacgtgcgggatgtgggtgacggcagcagcacctccagcactggcagcactgacagcccggaccaccacaagcaccacgcgagcagtggcagcccggagcacctgcagaagccccggagcgagggcagcccggagcactccaagcacaggagcgccagccccgagcatccacagaaacccagagcctgtggaaccccagatcgccccaaagcactcaaaggacctagcccggagcaccacaaacccttgtgcaagggcagccccgaacagcaaaggcacccgcatccagggagcagccccgaaacgctgcccaagcacgtgctgagtgggagcccggaacacttccagaagcaccggtcagggagcagccctgaacacgccaggcacagtggagggagcccggagcatcttcagaaacacgctcttggggggagcctagagcatctccccagagccaggggcaccagcccggagcacctcaaacaacattatggagggagccctgatcacaaacacggaggaggcagtggaggaagtggaggcagcggcggaggcagcagggagggcaccctcagacggcaggcacaggaggacgggtcaccccatcaccggaatgtctacagtggcatgaacgaatcaaccttgtcctatgttaggcagctggaggcaagagtaagacagctggaggaagaaaatcgcatgctgccccaggccagccagaatagaaggcaacctccaactagaaacagctcaaatatggagaaaggctgggggtccagagcccggcgggtcttgcagtggtggcaagggtgccgaggaataggacgatgcctgcctactctcccgggttcttttaggttgtcatcaggggctgatgggagtaacagttcacccaactctgcagctagcttcagtggacatgccacaccttcccagcagcctgaacctgtggtacattctcttaaggttgtgtggaggaaacttggagatgctgcaggttcgtgtcctggaattaggcaacatttgtcaggaaaccagtacaaaggaccaatgtgagatgcactctttttcaaacaggagatcaccactgccagaaagtgatagaagacaagaagaaaaaggaaagagtgggtttccacaaacctggactcatggaataacatggagtgattgtacattgcacatatctcccctctaaaacctgtagtacaacttctcccctcaagctgatattctgtgtctctcacctcaatgtccacaacagtcaatctcaaacaaggtagctttgaacatctcaaacagagtagctttgaaaatcaacattttggtaccagtgttttcattagaaataagtgtttttaactccccagatataatattgtaattgggaaacctgaatagttttaagagtccagtggagcctcagtgttttgaatagagatgactcattacacataatggtaggagttttctaccatatcatattgaagatatgaagaggtattttccagcttcccaagtttgagagttgggcatttacctcttacacttcagtcaacaaacaaactagtaattcctaatgcataattaatttggatgcaagataagattaagtttctggagttttgttttgacttctgaggtgctaaaaaataccatgtaaattctccctaccagctagaagggtagcaagacgttgtagagtgcttatcagagagtaccatttacttcaattgatcaatataaatatatctttttttttcatcttaatgagtttctcataaagacacatcttggggcataccaaccttcatattcattcagtgtatccattggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgatagtttcttgtatgaatgtgcaagaggcctgtgaccgaatgctacgtttttatggtagtttaagattataaaagtagaaatgcaacaattcccagtttttggataggttctaaatttctgagatttgattcatggcagatattctctgttgttgttgttttagatgggctcattacataacgagttaattgtcactagtaggagactgtgaaggaattttgttatactttcaaaaatgttactgtgatgaaaaatcatctattttcagaaaatatttatgaattaatttactatagaattatctctctaattatcataattgggttacaatttaagctccccttttaaatgttatattttaaaatgttattactctataaaagaaaattgcttgctatatttacaccttctttcctaggaaagctttcatccttaaattgttgtattcctaccctctgaagacatttaaaataagcttttgtgcctgcagcagagcctgcagaagctaatacaagggacactggtcttttgacaaaataaacttgtgtaaattttgatactgtattaaaactatttttttaaagttctgcataaaattgagtattaagtatatgtgttcatcttagcaatggtaataaattatttaatctcac

SEQ ID NO: 3424 - DNA, 9505 bp, Homo sapiens
  ENST00000336838
cgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaacaa

SEQ ID NO: 3425 - DNA, 9667 bp, Homo sapiens
  ENST00000263630
gttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaacaa

SEQ ID NO: 3426 - DNA, 4236 bp, Homo sapiens
  ENST00000444458
aaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaatactacatcctttgaagacataagtccacaaggtgttagtgatgattctagtacgggatcaagagttcatgcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatat

SEQ ID NO: 3427 - DNA, 2880 bp, Homo sapiens
  ENST00000412148
cttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaatttta

SEQ ID NO: 3428 - DNA, 4500 bp, Homo sapiens
  ENST00000426576
caactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctagtgagtaccatttacaccagtggtcctctcatatacttgacatcccaacacatactataggttcttgtgcccaaaatgatttagctatagacatgcctgagcctctatatgcccaggctagaaactcaagaacaggaaggtcacattttctaaaccaaacttttgccactattaggatgcctagtgatgcattcggaatgttggcaaaagatagcataggaccatttactgtggcccattcatctcagccattcttatccctgaatacagaattagttagtaacataagtgggttacctcctaggccagttatcagaataactgaccaggcttctgcctctttggataaacctgcacagaaagaaaatgaacagttttctgatcatcagaaccctagtaacagtaacctacagttttctataaatagcaacaatcttgtcacttctgcatgcctctatcctgatgacacagaagctgcattgttggtttctgaggataatcaaactgtttggtatgaatatggttgtatatgatcaaaactgcacaatataatatattgatgttatttgatatacactgcttctctaatatgatttgaaaagttgctgttaacaaaatatcatttggctaggtttttattttttatttaaaattgttgcacagtgttcagctgtacatgatggcatgtatattaatgtgaatgtgtaaccacaccaaaacctgcatgaaatattaattactttgtccattttctgcatgcctttaaaaaccttaaccatacatgctcctccttcacattttttgttgcctgataagattgttactttgatatccagaagcatgttaaaacagttgcatgctctcttaccaagaagacatttccaagtcatatttgctttgttgcttctggaaaaaaatgttcatttcctccctcccttcctcctcttcccacccctcacttgctctgactgtcactcctttttttcttccagaatgtgtactttatattacatatgtacagtatcagtagggaaaatgtaaaaagatgttgttttcttttgtcatttaattaggccatctgtcctgttttaaagaaatagttaataattcaacactttatataacaaatattaactaatacccatatttataaaacatttttcagatttaaaagattgttaatacttataaacttagtgttattcttagaaaaccccatcaaatttaaatgtgatttacacagtgactaggaacatttgtatttattgtttcttctctgcacttttcatcatctgataaatacaagagctcaagtaactgtcttttcttcaagatggcttctatacttgaaatcagttaatacaatagtttttccagttctttttttatagagagtcaaagagaaataaaccaaattatattca

SEQ ID NO: 3429 - DNA, 2208 bp, Homo sapiens
  ENST00000456975
taagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagt

SEQ ID NO: 3430 - DNA, 541 bp, Homo sapiens
  ENST00000474059
aaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaatt

SEQ ID NO: 3431 - DNA, 419 bp, Homo sapiens
  ENST00000476903
tttgaaaagtcttctgaataattccaaactggaacaaacaagattagaagctgaattttcaaaactaaaggaacaataccaacaattggatattacatcaaccaagctgaataaccagtgtgagcagggctctgagagtctgagtggaagtccacaggcaacttgaggcctagacttggaactgttacaccatcacttccacctctttctcttggccaaaagcattccaaattcaagaagaaggaaaatagattccacttctttacgggaaaagtgagaagtcacattgcaagagggcataggtacagggaagaaaataaatgcattcagttttttaatgaatctaccacatatgttatgtttcaatttaacaacatacagataaataaaaccaacgtagtatgatattcacagttaca

SEQ ID NO: 3432 - DNA, 536 bp, Homo sapiens
  ENST00000468534
cttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacaggtgagtactaagtctacttggcaaacagttgaaaatttttttttttttttgctcatacatgaattctttctgtactagctatagaaaacatttatatatttcaccctatttctggttccttccttcccttaaggaaagttctgtagccggg

SEQ ID NO: 3433 - DNA, 582 bp, Homo sapiens
  ENST00000430086
attctatgcagagatagctttatcaaatgtgcttcagctaagtaacaatccaacacaattattaatatttttccctcagtaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccatt

SEQ ID NO: 3434 - DNA, 3713 bp, Homo sapiens
  ENST00000471947
gttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaatgacagagtctcactctgttgcccaggctactggagtgcagtggcccgatcttggctcactgcaacctccacctcccggattcaagcaattctcctgcctcagcatcctgagttgctgggactacagcgcgtgccaccacagctagctaattttttgtatttttagtagagacggggtttcaccgtattaactaggatggtcttgatctcctgacctcgtgatccaaccgcctcagcctcacaaagtgctgggattataggcgtgagccgccgcacctggcctgtatcttttttttttaacttaagtattaagtatagcagcagcccctaaccttttttgcagtagggatcattttcatggaggacagttttttccacggaccagggcgggggccattagattctcataaggagtgggcaacttagatcccttgtatggcagttcacaatagggttcgtgctcctaagaaaatctaatgctgccgccagtctgacaggaggcagagctcaggtggtaatgcttgcctgcccaccgctcacctgccatgcagactggttcctaacagggcacagacctgtactggtcctcggcccaggggttggggaccctgaagcatagtactgaatgtgtatactgactaagacaaacctgtagttaatagtgaatgatcccaagcaggtatttgaaaacaaatctctagttattaggttgctttttttcttttcttttctttcattaatctgtatgggtttcatgtttcttttgagagagagagagtgtgctgagagagtgagttgtgtgggtgtgtgaactggaataaattagggagccctgatgtctagaagttaggtttggcctttgaaggtatgtttagtcagggaaacctatctgtggaggaagttagatttgatttaaaccttgaaaggtgactgaacttggatagctatccgtgaggagaggagggtattttaggccaaggaagcgttttaggggaaaagcatactgcatgtatgatttgggaaatggtgaggggactagccttagtggaggaaccaagttgaggaatagtacaatacagtattttaaaatcttaggtcatttattcctttgccttttaaaaactattttgcggctgggcgcagtggctcatgcctgtaatcccagaactttgggaggccgaggcttgcggattacctgcggtcagtttgagaccagacttgccaacatggtgaaaccccatctctactaaaaatacaaaaattagctgggcatggtggcacatgcctgtaaccccagctactcgggggaggctggggcaggagaattgcttgagcccgggaggcagaggttgcagtgagccgagatcatgccactgcactccagcctggccaacacagtgaaactctgtctcgaaaaaacaactattttgctaaattggaggtccccaaaacagtttctttctcatggaccatttgtagaccatgactgaaagttttgttaacttgactattaataattccttacctttctgtatgtgtatctttcctctaacttggttcattgcatctcaaatgtatgtgtggctattttttgtcttctattttactttttattatatttctaatttaatttttgtttgtcttagtgcttttgtaataggtatctattattttgcctttaattggtgggtttataatggagttagcattgagccttttggagcacttttctggtacactgaaaaagacaaattaaaccgatattgtggtaatcttattctactctcactaatagaaatttatatacttagagttgtcctgtgtggggactttttaaaaaattagagaaattgatgattggaaaaaagattttcttaccaaatttaaaaactgcttacttaaggtaagtttctatgactaaatttaattcattaattagaagacattgttctttgggatttttctctcattttaaagggctttcatctcaaaagagaaagtgatacttgtcacccataattaatcaagtgaactatttaaattaccttaggaggggagtacagattaagaagccttactatactgaattgatagtatgggagtgaaagccatagtagataagtctgtcactggtcaagggaaatacgtgactgtatatcagcccactttggaatttcttgagtctctaggcctaagtagatctggagcaattactactccagaatactgattaaaacaaattaaaaccaacttctgtgacccaatcttaaggcttagtgacaatgggtaaaatgttccatcacagatcagtgctgtccattgaatctattaaacaatcttcttttgtttcagttactggtcatgaggttggcaaccatgtaagtgaatgttctagattagcataatattaagtccccaggtctctataccaagaacaggaattgatttgcctaatacagtagttctcaaatgagatcagacccctgctagcacagagattccttcaaggttgtctgtcaggtcagaattattttcataataatactaagatgtcctttgcctttttatgcgtgtgttgctaaagcactgatgatgcaaaagcaaaggtaagtaaaactgctgacattttagtatgaatcaaggaattgtaccaaattgtgtgggcaatcattgtattcttctcgttacacacttgtaaggtataataaataaacccagtttcacttaaaaatgtccttgatgaagcaataaaagttattttgttgggtcttga

SEQ ID NO: 3435 - DNA, 9586 bp, Homo sapiens
  ENST00000413716
attggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgt

SEQ ID NO: 3436 - DNA, 3089 bp, Homo sapiens
  ENST00000621814
cgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaagaaaataaatcattagagcaagagacttctcaactggaaaaggataagaaacaattggagaaggaaaataagagactccgacaacaagcagaaattaaagataccacattag

SEQ ID NO: 3437 - DNA, 9811 bp, Homo sapiens
  ENST00000436346
attggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgt

SEQ ID NO: 3438 - DNA, 830 bp, Homo sapiens
  ENST00000334681
cacttcaaccggttgtcgccccagtggccgccctctgagcacgtgttactgccagtctgcgtcagcgttgggtaaatacatgactggccgacgccgccgggtggggctatttaagagacagccgcccgctggtcctccctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctgc

SEQ ID NO: 3439 - DNA, 1527 bp, Homo sapiens
  ENST00000396169
ctggcgttgccacagtccctccattccagagggaattccagagcggaatacggattccgattttaaaataagcgcttctaaatctttctccttgcatctaagacgggtgggggaaagaaagggagaggagttgaggtcccaaggttcaaggcctggtgatctccaggtcccaggctgggcggcctcggtgcacggagagggcgaggggcgtgttgtggagccttggcaaggcgctgctcttcctcgcgcctcggtttgcggtctgtgaaatggggttggcagtgcctttgcagggacgcggcgaactcaagcaccagcaagcggactcgaactcaaagggtttcagggtgtagacgaccagagcgcactgaggggctccaggtcggcccgctccggagccgggagagtaaccgcgtgcagggaaaggcgcacggcagcctcggtgcctcccttccctccaccggacgggtgactgactaggggtgaggtcctcacctccaggctgcgcagctgagttctggaagctgcgtcaagagaggcccaggacaccaagagccagctgtggccagagccctttcactgacccagaacactggccctcggaaacctggagaactgcgagggcttttaatgcggctgagaagaaagtgaagaccccgactcctcctctctccttcgaaagagccgacacaggagccacttcaaccggttgtcgccccagtggccgccctctgagcacgtgttactgccagtctgcgtcagcgttgggtaaatacatgactggccgacgccgccgggtggggctatttaagagacagccgcccgctggtcctccctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctgc

SEQ ID NO: 3440 - DNA, 747 bp, Homo sapiens
  ENST00000434608
gagaggcactctgcaaacacttcctcaaactttaggaaagcaaaaacattccttctgctcaacacggcagaaaacagggtctctgccccttggcgctgggtgaggagttcccaaagaccagccagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctg

SEQ ID NO: 3441 - DNA, 718 bp, Homo sapiens
  ENST00000484359
ctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaaggtaagaatgctgcctccccatccctcacttctgcccttgttcccaggctcccgatgctgaccctcttctctagcgctagcctgatggggatgacctctctcggtaggaaacaagcaacatgatttctggcggtcctttgtagcaatctgagaaggggtatggaggacttaatttataagtaaggggaaccttcttgaaaagctttctttgaactaatttttagcagtgttgctgattaagttcaacaccattttaccaagccattaaaagataattattgaagcctaggaaagggttcctagatacagtgaataccctctactgaaaacgcaaaggaccttggagccacccagataccaacccttggaaatcctctagcaggaaggggtcaatgctgagaatgcctgagatctggctacaacagtttaaaaaa

SEQ ID NO: 3442 - DNA, 2121 bp, Homo sapiens
  ENST00000334619
cgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcgttgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatacgaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgattctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 3443 - DNA, 1734 bp, Homo sapiens
  ENST00000532715
ggggcagggggcagggagaggagggcggcgggagcctgagccggaatcgcagcgtgagcaggtggagccgcgttgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgaggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatacgaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgattctgggatgctcctagtttgacctcacagtgacccttcccaatcagcactgaaaataccatcaggcctaatctcatacctctgaccaacaggctgttctgcactgaaaaggttcttcatccctttccagttaaggaccgtgg

SEQ ID NO: 3444 - DNA, 792 bp, Homo sapiens
  ENST00000525014
gcgttgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggtgggtgagacaaccaccccacccccacttgccactctccccgcctaaagctcttgtggatgtaggggtcttccccggttggcagggaggggtgtgaggaagtcccactgatgcttgtgtagtgcaagtttcctaggtgactccttcctttctcttcccttgtttaggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccg

SEQ ID NO: 3445 - DNA, 463 bp, Homo sapiens
  ENST00000531712
gccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagacagaacaaatacagatcttctaaacaccaggagaagaactgaactgtcccaatcttctgagtcgcctggtctgatgccagttttcctcatccccaggaagatgatgagatgatgctcacgggtagacttatcaaggcacttgtggatgtaccccagcagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgac

SEQ ID NO: 3446 - DNA, 2138 bp, Homo sapiens
  ENST00000525462
gccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggtggggctggaccacgtgagcaaaatctgggcgaggcggagctttggagggcgacggggcctgctggagtgggtgggactgaaatgaaggtgagggtgagaaggaagctggaaatggagttgagctgggagcggaggtcaggtggggactgggctggagactggggggactcgcctttttctctgaccgcccaccctttgtgctcaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatacgaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgattctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 3447 - DNA, 247 bp, Homo sapiens
  ENST00000532396
agggtccgaaaccaaggcgggctgccaggtggggctggaccacgggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcg

SEQ ID NO: 3448 - DNA, 2523 bp, Homo sapiens
  ENST00000262659
tcaccatggaatatgaagtcaagaaagggaagaagggctttgtatcccccatccgaaggctggtgttccccaaggccgggcgccgggcagcctgtaggagcagcgtgagccgccggcccctgcactcgatgcccctttatccccccgactacctcatcgacccccagattctgctgtgtgactacctggagaaagaggtcaagttcctgggccaccttacctgggtgacttcctcactgaacccctccagtcgggacgagctcctgcagctgctagacaccgccaggcagctgaaggagctgccgctgaagaccacggcggagcaggacagcatcctgagcctgtctgcccgctgcctgctgctcacctggcgcgacaatgaagagctcattctgcgaatccctacgcacgagatcgccgccgcctcctacctgcaggacgacgcgctgcacctgctagtgctcaagaccggtctgggtgtggacccggtgccggccggcgtggatgccagcccaggcggcgcaggacgcgaccccggcccgccaggcggggcgcccgagaagcggcgggtgggcaccgcggagcggcgccacaccatctgcagcctggactggcggatggggtggggtgggggcgccgcggaggcccgggccgggggaggcggcggcggcagcttggagcgccagcgcgccggggcgcgggcgtcgggcagctgggagcgacggcagacgttcagcggcagctgggagcggcggcacggaggcggcggcggcggcggcggcgcgggaaagccgggcggtagctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcataatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaa

SEQ ID NO: 3449 - DNA, 1841 bp, Homo sapiens
  ENST00000452892
gagcggcggcacggaggcggcggcggcggcggcggcgcgggaaagccgggcggtagctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcagtgagagctgccacacagatgggacgtatgcctatgatgccgacttcagctgctgcagctcctttaatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaa

SEQ ID NO: 3450 - DNA, 4307 bp, Homo sapiens
  ENST00000227507
gcttaacaacagtaacgtcacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 3451 - DNA, 920 bp, Homo sapiens
  ENST00000539241
tcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacaggtagggcaggcccggcagcccccggcctccccttgagagccggctccttaggtgaccctggccggcttcttgctctccacctgggtgctgtctgggaagatgtccccagaccccctcctgcgctggagagcgctcttccagctctggtgagcagaggccctggattgtttgtcgcgctggatggagggagatttgct

SEQ ID NO: 3452 - DNA, 553 bp, Homo sapiens
  ENST00000536559
cgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggtaagtgagggtgatgtcccaggcagccttgccggggcttacagggggagacacctagtgccacggaaatgccgaggctggtgccaaggcccccaagg

SEQ ID NO: 3453 - DNA, 568 bp, Homo sapiens
  ENST00000535993
cgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctggtaaccactggaccccgccgccccccgccccccgcgagccgcacgcaggaccacggggccggggaaggtgc

SEQ ID NO: 3454 - DNA, 430 bp, Homo sapiens
  ENST00000545484
cgcaggggccagtgctctgagccggaggtgcggcgtggcccggcccccgtgctgccggcttccccgcgcccccgggctggcccgcacctcccctgatggccgctcaccctgtgttcgcagcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccgg

SEQ ID NO: 3455 - DNA, 476 bp, Homo sapiens
  ENST00000542367
tgctcacagcctccttccctctctccttctgcctcagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttg

SEQ ID NO: 3456 - DNA, 6480 bp, Homo sapiens
  ENST00000261254
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacctttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacct

SEQ ID NO: 3457 - DNA, 529 bp, Homo sapiens
  ENST00000536537
ccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgctcaacaggtcggacagggtaagggtaagggatgtaaccaggagatgccacaggaacgtctgagaggtgttagcaagtcccagaggccagcgcccgactccatttcagcctcgttcagggtggcacggagactcctgctgctgcgtcacgtctgtcatgttcagcactcttcccagacacacagtcttgactaaagattgtcaggatcttga

SEQ ID NO: 3458 - DNA, 572 bp, Homo sapiens
  ENST00000536795
aaaactggtctggagcccaacccccagccccctacaccaggtcagcctgtggaatttagattctcctcttctcttcctgccttcccctccaggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggtaggtggccaccaccttcttggctaagtccagatgtctcttctcagctcagggaaggagacgacggatttgattatgttgtgtcagaggtatttttctggtttgtttcctaagatcgacatccaagggagtgcaaagttcagcaggtgacaccccctcttaaggttctga

SEQ ID NO: 3459 - DNA, 322 bp, Homo sapiens
  ENST00000541542
tggcagctgtcactcctcatgacttcattgagcacatcttgcgcaagctgccccagcagcgggagaagctgtctctgatccgcaagcatgctcagaccttcattgctctgtgtgccaccggaggaaggatctcaggaagtcaccagcatctcacctctccaggtgggcaattaacgatggcgagggcacaccctcacccctgagcgtgccttctgcaccagcatattgcttgttggcatttttgatcaagagacttaacagactgctgagaaatttgtacctggtttttatttgttaaaataatattacgtacaaattttac

SEQ ID NO: 3460 - DNA, 1940 bp, Homo sapiens
  ENST00000505587
ttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaaatcgccaaactttggcatcagagcaaggtccacacttatcactgaaaattttcccacccagccccattaaaaacgttaaagtgtgagagattttatttcaacactgacaagctagttactagagggcctacaaaggtaagtaacaagtttccatttcaacttgagagacaaatgatgttaaaatataagaagcagggtaagtcaggtttgtgattttaaataaaagggagaaggatttcagactgaggaatgacaggttagtatggctaaagattgaggtgtgataaatgggagccaaagtgcacagcaaaaatatcttgactaatccatatcctccctgtcttctatcatgtaaccaaggaaggagaccacctgggatactatgttggtccaagtccagctaaaaaacagaaggggtggaaaggagagtaatttgataaaagagccaagaagggagagaatggaatgaattgagctgatttcaaggaaaaggagcatgggacatgttgagatttttggtatcagtgttaaacggtgattgaagccacataggttagcagcccccatagaaataactgccttttgtagcttggaactactaagcagacatcttttaagcccttagcatttttttttcctgtattttatacattagaggaatagcataaagtgttgctcttggaatctagggctttccttactgtgggaacacctccttgggttcctgtctcactcactttgattaccaatgtcattctgccacgtatgttccatatgtcctatctatctgccctgcacaattatgagagggaaggaattattgcatttataaaatccttttcaaaagaggccattagcaaaaatactaatctaaagcttcagcttctccctgggccttgctctgatgctaaggtttaaactgcccctgaaggaggaagaaaataaataaattaaatgcttagctcttttagacagaagtaatcaattatgcaagatatcccttggttttattttaacttaacctttgtgaatacttcacaaaaatacacatacagaagtaaataaaactatacagttgaactaaatatccagcagatacaacaagtagtcagaagttcaaagatggataagttaggcagctgatgaggttgtctgcataatcaaaggggtagcacaaataatgaacaaataacttttaacaaaagcattctagttaacataaaagaaattggtagtctataaaatggttgaatgggtaacatgcattgatcaatacaacaaccaataatatttactgaattcaaactatttacttgtaaacatttaacaaagcattatgagatctaaatacagtctttgacaatttcaacaaaataagtcgtatgtttaaaaaataaagctgatgagcaat

SEQ ID NO: 3461 - DNA, 549 bp, Homo sapiens
  ENST00000510921
cttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggagatcgccaaactttggcatcagagcaaggtccacacttatcactgaaaattttcccacccagccccattaaaaacgttaaagtgtgagagattttatttcaacactgacaagctagttactagagggcctacaaaggtaagtaacaagtttccatttcaacttgagagacaaatgatgttaaaatataagaagcagggt

SEQ ID NO: 3462 - DNA, 2391 bp, Homo sapiens
  ENST00000508855
gcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggtatgttttactccaaagatgaactctaagttatttttgttatacattctggtgtgactatactgttaagatttattctccaagagtacaggcattatagagttgtgggttttttcattttttgcatacttccttacgtacagtactgttgtccattattaaagggatttttctctcttctgtctttatttaatgaagaatccttcctgtgttcatagaaagcagaagcaatatgtatacatactacatttttgctttttttcttattctccaaggatttttcccttacccccttttaaaaaaaattttctatctgtcaagtcaaataagtgaataatcagaggcaaaaggtcacagccataacctttattcctcactggaggagtctggtgagaccatgccaacattactaacagtgaactattacaaaatttcctggtttatcttttgtaatccacatgggtaaaaggaggagaacattttcttaaagggaggtaagaggtaaacaatactggttatgcttcagtgttatccttaccacactttttttccttcttaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaatagcacctgttttgaatattcttattccatcgtgactaatatcaaattaaagctgcaactcatttgcctaattttttaagcaaaatatgataggcaaacctatgctttttttaaaaaaggcaccacaaaaaacaaaacttagtagccagctttaaaagtgttaaggaatgtgttttgccctctagaaacctttataaatggctttttgaatgccatcctgatatatttagctatttgtccattactattaaactgcagaaggtatttcaactgttacatggtactgaaagccagtcgtctgggtaatgaatattatttttctttagttacccgaaaacatttccaaatgggtttttaaaaaaaaccagatatatgattttgaatagctgtctacatcaaactcttacgctagtatagataagtaggtagcagcaaattgtatattcagttgtggttgttttttaattttgttttgatgtaaggtcttgctatgttgcccaggctgtctcagactcctaggctctagtgatcctctgcctcagttttctgagtaattgggactacaggcacacatcaccacagccttataattaacctattagatcctataagtgaatccgtgtaagtagattataacagttactaggaattttgcagattaaatatgttagagaaatgtaattcaaattgaaatgagtcaatataaaaatatgaaagcacagactattacagcaaattacttacatatgaatcatggccagctgtatttcactatgtgaccttggtaagttattaaacctctaagtgccagtttcccacactgaaaatggggaagataaaaatgcctact

SEQ ID NO: 3463 - DNA, 1378 bp, Homo sapiens
  ENST00000256897
gggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 3464 - DNA, 1497 bp, Homo sapiens
  ENST00000504878
gccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggtgaggttttcccaacggttgcccagttgcccggtcactaaattctgagcagctgcgggagctcttctggctcccaggacaatctcgctccgtcgtttctctgcctctgcggcgcggagtgcgtttttctatcaaaataagcgagcaccttgccaggttccgtgggtacaaagacgaacaacgccatccccgtcgtcgaatggcagacaagtaaccagtctttgtaacgtagtgaagaagagagttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaaga

SEQ ID NO: 3465 - DNA, 451 bp, Homo sapiens
  ENST00000511207
agttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttc

SEQ ID NO: 3466 - DNA, 778 bp, Homo sapiens
  ENST00000504115
gctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattg

SEQ ID NO: 3467 - DNA, 606 bp, Homo sapiens
  ENST00000513499
gagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataataccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaaggt

SEQ ID NO: 3468 - DNA, 582 bp, Homo sapiens
  ENST00000510020
acgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataataacttgagatctctgtttacctgtacttcagtaattctgatggctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaactta

SEQ ID NO: 3469 - DNA, 587 bp, Homo sapiens
  ENST00000505230
gctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgtgagtatgtctgtctaatatattgttttcatttaagaagacctttataatcttttgagtattttttgggaggagagaattgtgagagagagagagagagaactgacttcctaatacagggtaatttagacttgaattctatttttttttttttattcagaacttgagatctctgtttacctgtacttcagtaattctgatggtatgtgaacttcag

SEQ ID NO: 3470 - DNA, 3324 bp, Homo sapiens
  ENST00000369470
gcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaagcggagacgtctacgtggagagggtccagggcaactcagtcttgttgcacatctcaaaactccagatgaaggatgctggcgagtatgagtgtcacacaccaaacactgatgagaaatactatggaagttacagtgcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccaggtttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcatgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaagtgatgttaaccaacacctttgacctgtcctgtgtcgtgagggccggttactctgacctcaaggtgccactcactgtgacgtggcagttccagccagctagctctcacatcttccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagtccaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcac

SEQ ID NO: 3471 - DNA, 688 bp, Homo sapiens
  ENST00000467588
atcttttgcccatgtggttgcagtcaatccaatttaattcagatcagcaaaagttactgagcacatgtgctaggcactgtaggggatatagaaacaaatggcactatcagacatactcaagtaactatagtgaacaaaggagacgagtaaaagggaattaaagaggcctaaacaaagggctgagtgagaacgggatggaagagaagaactgtgcctgcagcaagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagcttcctgccttgctgcctgtttcttcccaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgc

SEQ ID NO: 3472 - DNA, 409 bp, Homo sapiens
  ENST00000460180
tggaggtgtgaccacaaataggagggaagacgaggaggaagatgaaggcaactgaatcccaagaggcacctgcagccaggaaggaaagcttgttttacagcttcctgccttgctgcctgtttcttcccaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcactctctcccctctccatcaccccataaaaccctcctgtcactttccttcagagacaccgc

SEQ ID NO: 3473 - DNA, 3283 bp, Homo sapiens
  ENST00000256652
agcatttgtcactcaacctctgaatgttagtgacactattgggacgaaaaaggactgtgctggcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaagcggagacgtctacgtggagagggtccagggcaactcagtcttgttgcacatctcaaaactccagatgaaggatgctggcgagtatgagtgtcacacaccaaacactgatgagaaatactatggaagttacagtgcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccaggtttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcatgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaagtgatgttaaccaacacctttgacctgtcctgtgtcgtgagggccggttactctgacctcaaggtgccactcactgtgacgtggcagttccagccagctagctctcacatcttccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagtccaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaaggtgggggctttttaattgggctaaccagggtgtgaatgaatcctggttctgtcctcaactatgtctgcggccttgggcaagttacctaggaatcagagggagcattcactgagtgc

SEQ ID NO: 3474 - DNA, 1338 bp, Homo sapiens
  ENST00000266557
aatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 3475 - DNA, 1045 bp, Homo sapiens
  ENST00000541233
gggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 3476 - DNA, 1494 bp, Homo sapiens
  ENST00000436584
actcccttcctcttttctgctcacacaggaagccctggaagctgcttcctcagacatgccgctgctgctactgctgcccctgctgtgggcagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccggtgagtgatggggcatcctggcatccagtctgtcctgcagacacctcctcccaatgtggcccaccgtcatgccccattcagcatttccagaactgagcttattgtctttcctcctgtttaacagtgtaggttttaatatttttcaggtacgttgaggccaacagatcaggagatgatggccattgaaaagatagtttcttggccgggcacagtgtttcacacctgcaatcccagcacctttggaggccaaggcgggcggatcacgaggtcaggagattgagactatcctggctaacatggtgaaaccccgtctctactaaaaatacaaaaaattagccagatgtggtggctggcgcctgtagtcccagctacttgggaggctgaggcaggagaatggtatgaacccgggaggcagagcttgtagtgagccgacatagcaccactgcactccagcctgggtgacagagagagactctgtcccaaaaagaaaaaaaaaatagtttcttattcaccgttcccgagagggcacaccacaccatgcaaggccatatggagaagcaccagggtcagtcaggaagcagagggagcaaggagaaaatgggacaagagccttcactgtggctttcatggaaaagaatgggcaagacagggtaagcaagctaggcaggtttaggattggctacttagaacaatttcagcagactctggggtataggagttgtctctagttgtctggtacatggccctgggtttattaaggaggattgtggtctggagtgtaagagctcaataaaggatccagctggtagtgtgggctttagattgactggtttgcacatgaaaggtgcacttgtatgcaagtcctttattagctctagaaatctactatccttggg

SEQ ID NO: 3477 - DNA, 1023 bp, Homo sapiens
  ENST00000421133
actcccttcctcttttctgctcacacaggaagccctggaagctgcttcctcagacatgccgctgctgctactgctgcccctgctgtgggcagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctg

SEQ ID NO: 3478 - DNA, 1089 bp, Homo sapiens
  ENST00000391796
ctggaagctgcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccggtacgttgaggccaacagatcaggagatgatggccattgaaaagatagtttcttggccgggcacagtgtttcacacctgcaatcccagcacctttggaggccaaggcgggcggatcacgaggtcaggagattgagactatcctg

SEQ ID NO: 3479 - DNA, 1444 bp, Homo sapiens
  ENST00000262262
ctggaagctgcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacacca

SEQ ID NO: 3480 - DNA, 1522 bp, Homo sapiens
  ENST00000601785
ctactgctgcccctgctgtgggcaggtgagtggctgtggggagaggggttgtcgggctgggccgagctgaccctcgtttccccacaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcattccctcattccaggctcataacaatggccccacagcctgagaaaaccaggctcaaagaccctggtgtctcccatcagagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcat

SEQ ID NO: 3481 - DNA, 4728 bp, Homo sapiens
  ENST00000598473
ctcggtgctcataatcaccccacggccccaggaccacggcaccaacctgacctgtcaggtgaagttcgctggagctggtgtgactacggagagaaccatccagctcaacgtcacctggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccggtacgttgaggccaacagatcaggagatgatggccattgaaaagatagtttcttggccgggcacagtgtttcacacctgcaatcccagcacctttggaggccaaggcgggcggatcacgaggtcaggagattgagactatcctggctaacatggtgaaaccccgtctctactaaaaatacaaaaaattagccagatgtggtggctggcgcctgtagtcccagctacttgggaggctgaggcaggagaatggtatgaacccgggaggcagagcttgtagtgagccgacatagcaccactgcactccagcctgggtgacagagagagactctgtcccaaaaagaaaaaaaaaatagtttcttattcaccgttcccgagagggcacaccacaccatgcaaggccatatggagaagcaccagggtcagtcaggaagcagagggagcaaggagaaaatgggacaagagccttcactgtggctttcatggaaaagaatgggcaagacagggtaagcaagctaggcaggtttaggattggctacttagaacaatttcagcagactctggggtataggagttgtctctagttgtctggtacatggccctgggtttattaaggaggattgtggtctggagtgtaagagctcaataaaggatccagctggtagtgtgggctttagattgactggtttgcacatgaaaggtgcacttgtatgcaagtcctttattagctctagaaatctactatccttgggaaaggcagtctctcaagggtcagtaatgccccagatgtcaaaacatcagaaacacttggttgacacacccctaaacatacttctcctgatgggttctccatctcgctgatggcactcttgtccccattacccaaccagagacatggccccctcctgtcccagtcctccatctcttcctgtgccagtatgctacgatgcatgtctgagcttcctctgaacacggcttaacacaaccactcctgagccgagagcccctcttactccttattctgctgcagcctcacctcccatttctcctctccagaacattagcatcacctccctaaaaggtcattgtcccatcattcccaagtttgaaatgcactgcttctctacactcctgaaagattggcattccaacaacttggtctggcatttggagcaggaaaaccagagtccccttcagtgctatgctcccccaacattagccactcaatcacctcaagcagggcaagctttctcatctcagaatcattgctgggctgtcccctcctcctcatatgcctaatagctacctgcccaactccagtgcatccttcaagctctgattttttttttaatttatttaactctgactaaagtgaacaccacagtaaagtttttgaacacagggtcaaccagcacccattcattctgaaatatctatataatcccatttgccaattgctctaggtccttgtgccattctgtatttttataaacacacagtttacaaatataaaatattcctcctatcgggggcttaacatttattggggaaagggatgaaaataatgaacaaataagcagtgcaaatatacatgaaataggcatgaaataagtgctatggcaggaaatgaaatgggagaacggattggacagtcctgggggccaaagaatggcctttgggcaaacacctgcagaaagaaagtgagtacagtatgagcagtagagaatcatcaaggaagcagcaagtaccatggctctgaggccggaacacatctgatgttttagagaaacaaagtaggacagtgtggataaggcagagttacgtgttgggggtggagtgtggactgaacaatggtaggtaggaaatgaggttgaagagacataggagctgcaaatattgcaggatcctaagtccatcatagttattgatgcgtttagagcagaagagtgacatgaactgacactcattttagtgggagtcactctggctgctctgtgagaaactctagtatgtagtatagaagagaagataccagaatagaagatacacagataatcaagccaagagatgactgactcagacttagtcccaagtaagaataatgaatctgatgtggagaaattgggttccggatacatcttgaaggtggagtcaacagtatttgcaagtggagtgatggagtgcatgcaaggcatgagcaaagatagctcacgggctctgctcgataagtgtctcagatgtcataggtgggtccacagatatcatagatgtcatggatgtccaagaagaccccatagatgtcatagatgtctatagatgccaatgatgatgttcatgtggttaactcagaattcaaacttaaaaaatcaaattgccaatgattaaaattgccatccttgaaggagaagtctattttcaagtgtatatcaaacattattttggttaccgtaagtttgaggtgcctctgagacatccatgtggagatgacaagtagcaggcaagtgtctggagctcagaagagggctccacgtgggagacacagaggttgggagcttccctatcaacatccaataatcgatgaatctacaaagaagagaaggggtccacagacacagccctggaaccctccagcatttaatgttagggagatgaggtgtaaatggtgagaaagctgagaatgaataggagccaatgaccaggaaattgcaggctgtagtgttggtggccaagggaagatggggcttcatggaggagaggttggtcatttgtttcaaatgctggtaagtctggtaagatggaatctgagaaatggctatttgaatgtagctaagtggtatgacagcaaagcagatctgatttttctgctggaggaagatctcttgactagagagagttcaagagagaatgggaggagaagaggcagaaactgtgagttgaaggactcttttgagaaacactgccccaaatctagaaccaagaaatgggcctgcaccagcaaatggttgtaccctgtagacttgccatttctccagcatctgctcctgtgtctcttatgataccatgttccctgtttgtgtagggctttgcaccacttgaactaactgcattcccatagcttcccctaccacaccatgagctccacaaggaaaagcctgggttttattagacctccatcattctactctctcctgttcatctgcacactgtcacaatttgcaattaccagtctgtttctgtcttcatcccctgcagtactggaaatcacagggcccctgctctgctctgctccctcctgaggatccagtgcccagcacataggaggtcccagagacctgggaccgagttcagggtcaacagatgtgtgactttggaaattacctaagctctctgagacctagtttcctggtctgtaaaatggattaaaataatagatgccaaagatgatgtcagtgtagctgcccagaatttttccacattagtctctgtgagtattcaagagaattgcgaatcaatcaatacgtgctacatgtgttagataatgaataagtagagccttaattaattaacatttgatgaaagaatgaaagagtgaataaatgttctgtcagagtcaaatttacttcattgaccctctttgccttctcctggtccccctcctcactgccctgctctaacccccttctttcctctccataagaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacagatcccaatttaggttcctctgcctgttcctctaagaggccactgtttgaaccacttcctgaatctgtagccaaaaattggaagcaacccaaatgtccatcaactaatgaaggaataaacaaaatctggtacattcctgcaatgcatatcattcagacataaagatgggccgaagtacagatacatgctacaacgtgtatgaacttcgaaagcatcacaccaagtgaaagaagccagacactaaagatcacgtaccatatgattccattgatatgaaatgtctagaataggaaatacatttctggaggcagaaagcaggtcggcggttgccaggggcttcgaggagggcagtgactgcttagtgagtacatgctttccttttggggcaatgaaaatgtttagaaccaaacagaggttgtggttacacaacgttgtgtatgtactgaatgccaccgagttgttcactttaacatgttcattgtatgtaacgtgattttacatcaataaaaaaaaataat

SEQ ID NO: 3482 - DNA, 536 bp, Homo sapiens
  ENST00000600557
tcagtgtagctgcccagaatttttccacattagtctctaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacacc

SEQ ID NO: 3483 - DNA, 881 bp, Homo sapiens
  ENST00000423145
ggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaagggctttttggattttggaactggggactcaaagtcaagtgcttcttacggcatttaatatggactgcacactgttttatcccattaactcagctcgtgttcatgcaagccctacaaagctggaggaatcatcattgttcccatttcacagatgaggaaaacagaggcgtaaaccgttgagtcatctgtccaaagttactggttttgtaacagctggaacctcagtatttaacagttgaggaaaatagtggcagaaaacctgagtcacaagcccgaggcaattcatctacatagtag

SEQ ID NO: 3484 - DNA, 913 bp, Homo sapiens
  ENST00000245903
ccagagaggggcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtggtggcaggacaagagaaggcattgagctttttctttcattttcctattaaaaaatacaaaaatca

SEQ ID NO: 3485 - DNA, 572 bp, Homo sapiens
  ENST00000597430
tttttgaccttcctgtttcctggaactcagccatggtggtgtgtcactttgtactttgcagacaagggcatcacctttgatgtgtcggaggcacttcagtgaaagaattttggctcctaaagattttgcagaacagagatgacatgccagcccagactttcatttccaggaggccatgaattctgggaggacaccgttaacccactacagccatcgagaacagcagcaggaggctggatgcggtggctcacacctgtcatcccggcactttgggggacctacgcagcaggatcgcttgagcccagatgtttgagaccagcctgcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacag

SEQ ID NO: 3486 - DNA, 1138 bp, Homo sapiens
  ENST00000377795
ccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 3487 - DNA, 1449 bp, Homo sapiens
  ENST00000353334
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatgg

SEQ ID NO: 3488 - DNA, 1727 bp, Homo sapiens
  ENST00000518797
caggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagcc

SEQ ID NO: 3489 - DNA, 584 bp, Homo sapiens
  ENST00000524315
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggaagtggccaaaagctagacagatccccgttcctgacatcacagcagcctccaacacaaggctccaagacctaggctcatggacgagatgggaaggcacagggagaagggataaccctacacccagaccccaggctggaca

SEQ ID NO: 3490 - DNA, 981 bp, Homo sapiens
  ENST00000009530
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatct

SEQ ID NO: 3491 - DNA, 767 bp, Homo sapiens
  ENST00000523208
ggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagccc

SEQ ID NO: 3492 - DNA, 816 bp, Homo sapiens
  ENST00000517752
cacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaaggtacagggagtgggagctttagcgtgccagggcttctggaccctcggggctctcctgaagctgctgaggccggggcctccagcactccctggtcccagcaccgcggaatctcccatcctctcagctctcacttctttctcacttctctctctctcctgtctgttccttcttggtttggctgtccccctcccctg

SEQ ID NO: 3493 - DNA, 563 bp, Homo sapiens
  ENST00000522246
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagccccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaaggtacagggagtgggag

SEQ ID NO: 3494 - DNA, 546 bp, Homo sapiens
  ENST00000523813
agatgcacaggaggagaagcaggagctgtcgggaagatcagaagccagtcatggatgaccagcgcgaccttatctccaacaatgagcaactgcccatgctgggccggcgccctggggccccggagagcccatgcagaatgccaccaagtatggcaacatgacagaggaccatgtgatgcacctgctccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctga

SEQ ID NO: 3495 - DNA, 724 bp, Homo sapiens
  ENST00000523836
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctcagcactttgggaggcctaggcaggcagatcacctgaggccaggagttcgagaccagcctgg

SEQ ID NO: 3496 - DNA, 1015 bp, Homo sapiens
  ENST00000517791
acatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcgtgcgtgcacccctacatcctgataccccccacctcccaccatccctcaactcagagacccgcatccctgcacccagctgggcccactgtcctctccctccggtttggaattccagcccttcctcatctgggtctgataccctcctccctgggcaccggggccacacttaccctcgttcctgtccccacagctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctc

SEQ ID NO: 3497 - DNA, 556 bp, Homo sapiens
  ENST00000522153
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccagggggtaaggacagccccagggtggtgggaggggcaaggttatcccgcctggatggaggacagtgccaaggggaggggcagggaagagagcccacctggggaggggtcctgactgctgcgggagggacagtgcctgcctcaggaagaatcgggctccccaggtgtggagggcacaggtga

SEQ ID NO: 3498 - DNA, 538 bp, Homo sapiens
  ENST00000526958
gtgagaggacattgtgataatggaagtgaaagagctttgtcagctgcacaggtgaatgcccctggtcattaaccagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatc

SEQ ID NO: 3499 - DNA, 2289 bp, Homo sapiens
  ENST00000227155
ggcctgccgagtccgcggcgttccccggctgcagccgggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccatcctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtcta

SEQ ID NO: 3500 - DNA, 967 bp, Homo sapiens
  ENST00000342935
gtccgcggcgttccccggctgcagccgggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactga

SEQ ID NO: 3501 - DNA, 580 bp, Homo sapiens
  ENST00000532544
gagtgactgagccccgggctgtgcagtccgacgccgactgaggcacgagcgggtgacgctgggcctgcagcgcggagcagaaagcagaacccgcagttcaactgagccggaccccctaagacttcaagttggaaactcagtggggcttttccagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttc

SEQ ID NO: 3502 - DNA, 582 bp, Homo sapiens
  ENST00000529277
agtgactgagccccgggctgtgcagtccgacgccgactgaggcacgagcgggtgacgctgggcctgcagcgcggagcagaaagcagaacccgcagagtcctccctgctgctgtgtggacgacaccctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccatcctgactgaaagtagggggctttctggggcctagcgatctctcctggcctatccgctgccagccttgagccctggctgttctgtggttcctc

SEQ ID NO: 3503 - DNA, 468 bp, Homo sapiens
  ENST00000525210
gcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaagcatttagagtcctggagtgctggtccctggggaggctcggcagcaggtcctggcattcagagctggcccagggttgagcacctgacacacccccaacctgccctgcgggcaaggacagaagaggcctgagaaccgtctcttcggactcaggggcagtggaactcagactgccttcaggaagctccaggactggcgggatgggctcagcctgtatcaaagtcaccaaatactttctcttcctcttcaacttgatcttctttatcctgggcgcagtgatcctgggcttcggggtgtggatcctggccgacaaga

SEQ ID NO: 3504 - DNA, 1405 bp, Homo sapiens
  ENST00000525898
tccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctggtgagtacggatccctccgcagctgcctgcccatttcctctcatccagccgagtgcagcctgaccgcggcgctggccgtaacatcgggtggagagcatctctcggggcacgcaggctgggtgcacctggtcggggaccctcagctgactttgtgcctgctctgtgtccccagtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccatcctgactgaaagtagggggctttctggggcctagcgatctctcctggcctatccgctgccagccttgagccctggctgttctgtggttcctctgctcaccgcccatcagggttctcttagcaactcagagaaaaatgctcc

SEQ ID NO: 3505 - DNA, 654 bp, Homo sapiens
  ENST00000527737
gaggcacgagcgggtgacgctgggcctgcagcgcggagcagaaagcagaacccgcagccccttacccaggagcagcagtggtcatcttctggcacggagcctctccaggatgggcacatggctagagactggatcaggcctcagagggcttcagactgttggtcaggaaagcaacaacttttccagatcatcatcatcatcatcataagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaaggtaagcccc

SEQ ID NO: 3506 - DNA, 584 bp, Homo sapiens
  ENST00000524704
agcagaacccgcaggtgagcaagggggcagcgggccggggtagcctgccggacaaccataggcaaagttagttttagcccccgcttctgcggtccggctcggacaactttcctcggaactagtgacaggtcggggcagctggtgggtgaaaaggagctttagccaccagtcctgaacccccagttctcacactcggccgtgcacagctgcgtgatcctgggtccgtccctctacctggctctggacctcccgggttccagcaggaggaagtgaaccagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctc

SEQ ID NO: 3507 - DNA, 573 bp, Homo sapiens
  ENST00000525813
aagcctcccagggcgtggcgtgaagcggggatttggtaggggagcgcagagcgaggcctgaggtgtttccctggcagaggtccctccactgggaaacaaacggagaggggagtatgtgttcccacgtgtacacataaaccgttttgaatgatacctgagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccct

SEQ ID NO: 3508 - DNA, 679 bp, Homo sapiens
  ENST00000529853
tctggcagagaaacccttttgcaaaggccctcaggtaggtataaggacctggggcctgatataccaggacaacaggaaagaggctacatgagcctgtggggggaagaggacagaggaatggcaaccctggcggggccccgccggccacacggggagcctggatttaaagtgagtatgtcttcagccacattgcctttggagagtcacagacaggagtgacgagatctgggtcgtgtttttcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttgtaagtatgtcccatgccgtcctgaccacctccgaaaagattctccttccaggggcatcccagcctgagcctttccagagccgaccgggccggggattggggggatttggtgggtagggactgaggacgaactatctccaacggaacctagttggggtggtgaggagattccctgccattcccagctggtcctttgaccaagcactggattcctgacccggccttcccctctcctagatcacccaaagcctgggctggcggtgggtatggg

SEQ ID NO: 3509 - DNA, 581 bp, Homo sapiens
  ENST00000530601
agtgggcttccatcaaataactactcaaatgcatgaaaaattgcagttgttgggggtactaggaacagataggctcttcggaaagcagatgaggctcttggcctggtcatggagatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcga

SEQ ID NO: 3510 - DNA, 891 bp, Homo sapiens
  ENST00000530931
atggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccatcctgactgaaagtagggggctttctggggccta

SEQ ID NO: 3511 - DNA, 757 bp, Homo sapiens
  ENST00000524750
gacaacagcctttctgtgaggaagggcttctgcgaggcccccggcaacaggacccagagtggcaaccaccctgaggactggcctgtgtaccaggagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccatcctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtga

SEQ ID NO: 3512 - DNA, 2471 bp, Homo sapiens
  ENST00000379153
gcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaatgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaa

SEQ ID NO: 3513 - DNA, 2307 bp, Homo sapiens
  ENST00000612003
gattatcacagattctggagaagagtgaggacttgggttcaccacctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaatgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaa

SEQ ID NO: 3514 - DNA, 1556 bp, Homo sapiens
  ENST00000382518
ctgcccagccctcagctgtgttattattcggtgataggtatttgctaattacttccaaaagcctcccatctgtcatcccacccagactgcgcgcttctaattcctcctaccccacatgctgtgcccaatgaaaagtatggtcagcgagcgaaggtttgcaaggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccaccgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtc

SEQ ID NO: 3515 - DNA, 969 bp, Homo sapiens
  ENST00000543916
gaaaagtatggtcagcgagcgaaggtttgcaaggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccaccttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactggtgagtatcccctcggcatccccacagccaccctgactcccaccaacaaaaacctcagcaggcccagacccagaccacagaacagatggagggggatggggtcaggaaggtacccaaagggcatgagctgtcctcagcctgggcccctccccgatgtgaggcgtcgcccctcttcctttctggagcctgtcttatcgcttcccctaggcaactaaaaggactatgtttcccccttttctcgaggaccacgtttgctttttttccctgaatccacaggtacctttgccttctccttcttgtttcaaaatctgttttggtcttttccgaactccacggagtggattcgctccctttacttgcccaaatctcttgtcttttgtgaacaatagtagttgcctgctcactgactcttaactaacgccttgtaaatgctagttctgggctcagctgtgctcagctctttcctcatgtccgggcaccttgcctcactgtggcctctgtcctgggcttggttaactgcctgttctgtgaac

SEQ ID NO: 3516 - DNA, 739 bp, Homo sapiens
  ENST00000536586
aggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccacccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaac

SEQ ID NO: 3517 - DNA, 800 bp, Homo sapiens
  ENST00000382519
cggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactggcaactaaaaggactatgtttcccccttttctcgaggaccacgtttgctttttttccctgaatccacagttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtgg

SEQ ID NO: 3518 - DNA, 1072 bp, Homo sapiens
  ENST00000546073
agccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactggtgagtatcccctcggcatccccacagccaccctgactcccaccaacaaaaacctcagcaggcccagacccagaccacagaacagatggagggggatggggtcaggaaggtacccaaagggcatgagctgtcctcagcctgggcccctccccgatgtgaggcgtcgcccctcttcctttctggagcctgtcttatcgcttcccctaggcaactaaaaggactatgtttcccccttttctcgaggaccacgtttgctttttttccctgaatccacaggtacctttgccttctccttcttgtttcaaaatctgttttggtcttttccgaactccacggagtggattcgctccctttacttgcccaaatctcttgtcttttgtgaacaatagtagttgcctgctcactgactcttaactaacgccttgtaaatgctagttctgggctcagctgtgctcagctctttcctcatgtccgggcaccttgcctcactgtggcctctgtcctgggcttggttaactgcctgttctgtgaacttcttccctgcccctgctaggctattcatttgtgtcaccagatgcctgttcccagggagttgtccttcttccttgtcccaaaataccctttgattttcctggctggttggctgggactgttctcaccccgtcccctcgttgccttccagttcttcggcttcctctt

SEQ ID NO: 3519 - DNA, 564 bp, Homo sapiens
  ENST00000538834
ctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctgggttggggtcagcgggactttatttggatccaccacaggtcttttcaaccaaagccttgcagaaacaggctttaccccatacacacagaagagcaacgacttccttgttaagagtctgaaaatctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggt

SEQ ID NO: 3520 - DNA, 441 bp, Homo sapiens
  ENST00000538418
agtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggtgagggacggggaaggctcagtgaattcagaccctggctccaacaaagttcctgcaactttggaggccccatgttgacccagggacttgggcttgggaaagacttttgctctagccacgctggccagtcgtgtccctttcaagttgtgcagtttttgtgtgtgtcgttgtgcctgggaatttgcgtttaactgatgtggtt

SEQ ID NO: 3521 - DNA, 1169 bp, Homo sapiens
  ENST00000009180
cgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatg

SEQ ID NO: 3522 - DNA, 1229 bp, Homo sapiens
  ENST00000382515
gtggggagccgggccctcttgagatgaggcgtgcgggagggtcctgagcactttagctcgcctaggatttgagctggggtgtgtgtctgctcccagctcaagtccctccgagtgccagagaggaaggcagggagaagcggagcacccctctttgggccaaggccaaggaggactgtgcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatg

SEQ ID NO: 3523 - DNA, 1280 bp, Homo sapiens
  ENST00000481267
ctttatcatttataggcacatgtaagcgtctagctctgtgtgcatccctaaacagcatagcgtttttaactacatggaatcatattgtgtgtgtgcctgtggctctggcttcttggtttagcattgtgagatgcactcatggtgttgcgtgtagctagagttactcgttttcactgctgtatagtgttctgttgcctataaaataccccttcagccaatgggcggcagcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatg

SEQ ID NO: 3524 - DNA, 642 bp, Homo sapiens
  ENST00000540891
atctgctctgacagcgtcctctgtaaggcagggtcccagaagttagccagagtgtggaaggtatatgctaactagcttgagtggattcatcttgctggaaagagctgacagactggaccagtttgcattccgaatgtagggattcccgtggatattctctgtcctggattgagggctaatgggcaccttccagaagggctgagggtaaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcat

SEQ ID NO: 3525 - DNA, 1315 bp, Homo sapiens
  ENST00000610354
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcggttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggactggt

SEQ ID NO: 3526 - DNA, 3386 bp, Homo sapiens
  ENST00000251108
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggttta

SEQ ID NO: 3527 - DNA, 706 bp, Homo sapiens
  ENST00000496952
gccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtgagtgtccgggaccctgctcccgccaccctacctttcgctctgccctgtgcgtctcccgtcattgaactccagattccttgtctgagcctctttgcctcccctgctgcttttggatgtctcctgcccgccctctgcgtgtcccctccgcggtcgccaggaccaatcggctcggtcgcactggcttttgaagtctcgctttttacccctgttagctacttctcacaggacctagagctggggcctctgaggtcaaagagcctgaacatttccaaacggcgcttttgccttgatttccaaattaaccgcacgtgacgctttcctgtatttcgactgctttaccgtcgaaggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggt

SEQ ID NO: 3528 - DNA, 688 bp, Homo sapiens
  ENST00000496061
acagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatggattactggaagcagctaagatgcctagatgaaaggtttaccatcactgctggttaggaaatggattatgagaactcgaacagagggaaggtgaaatgcaaccggaggaaacactctgatatgagctggagttaaccgaatttcatactggcctgctgatc

SEQ ID NO: 3529 - DNA, 677 bp, Homo sapiens
  ENST00000466868
gctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgtta

SEQ ID NO: 3530 - DNA, 644 bp, Homo sapiens
  ENST00000484126
gggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacagaaaaccatgttctgcttgtttgaaaatgattgtaaatggattactggaagcagctaagatgcctagatgaaaggtttaccatcactgctggttaggaaatggattatgagaactcgaacagagggaaggtgaaatgcaaccggaggaaacactctgatatgagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatgg

SEQ ID NO: 3531 - DNA, 290 bp, Homo sapiens
  ENST00000429346
ctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggattactggaagcagctaagatgcctagatgaaaggtttaccatcact

SEQ ID NO: 3532 - DNA, 4960 bp, Homo sapiens
  ENST00000474602
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcaccgatggttggctgtcccaggctgtcacctttctagaccggcttctgatctggctcgggatccacaaggactagacctgcggggaaggtctctcctggacacgcccgttgcccactgcaagttctctccaggtgcaattgaagcctctcagcagcggaggccgccatgtggagagagcaggcaggcccactgctgctgagaacagggcaggcacgggcagctcctgttctgcctttcccagcttcggagacgcaggctcagctgctccgaagcacctgccagcaccgcacagtacagtttcagaggacagcagtctccttcccgtgaagctcccatgtgctggaatggcatggacttgctgatcaacagaaggaaatggtctgaagtctgaccagcacaaggaaggaggctggctggctcagaggggcccaccttgcgtggaatgaaaacgccaaaggctcatgagcaacattaggctagaggggtcttgttcaaagcatccaactctgacttcggaggcattcccagccggcagcagtgtgtccagcctgcctcttcccaggctggtctgacatgcagcttaggctttcatcccaagttaggtactgacccctccctcttgggcagcacctccctttttaaaaaaatttttttttcttccaaagacagagtcttgctcttgttgtccaggctggagtgcagtggcgcgatctaggctcactgcaacctccttctcccaggttcaagcgactctcctgcctcagcctcctgagtagctgggattataggcgtctgccaccacgcccggctaatttctgtatttttagtagagacagggtttcaccatgttggccaggctggtctcgaactcctgacctcaagtgatctgcctgccttggcctcccaaagtgctgggattacaggtgtcagccaccgcacccagccaagcacccctatctctagaggatctggccccccagcccagttactgcagggcagctttccccacctggtgacaggctgtgcgcagcagccccaggacctcaccctgagctgagtcttcaggagccgccctggtggcacaactcagacacccctgaggcctagcagtcaactcctgattcagacatgatccagtccagcctgggcttggctataaccagctcaaacttgcttgacctccacttttcaggagacttggggacgacagccctcatcggcgtctttcatggggttaatctgcttgagtctaagtcgccagccagaaacgtggtgcccagggtgccctgcctcaggacatgtccacacccacgtcacaagcacctgaggagtccggccggggcactgtggtccaaaaggtcctgccgcctccgcatctgactgtcccaacggcatgctggtgacacccccctgcccttcgcttctgtcctccctggcttctctggggcacttggggctatgtacaacctggcacgatccagaaagggtgcaaacaaaatgcctacatccaggcacacgaccaagtcagcgagagctagccctggtaagcaaacatagcccattacaggttcagaacgtgcaccgggttccccaaaactgtcttcaaccacatgactcaacagctctatgggataggaactgtcagtgtttttgcaactgcaacattaaaccaagtgctgtgggcttttcaagtattattcacaacactaaaggaaagtttcttcaaagggctctctggctaatcttcaaagccgcagttaggcaaaatgacagtgtgacagcttcaaagccactgactcatgacacagccctgatgttgtaccggctaggttcagatttcagaaatcagggcacttgcatccattgccttttccaggaaagggaagaaaacactcagttgataaaccttagtactcagataataaataagagaccaaaagtaggctatcacccaaagcaaacatccttaactgaccctaacgtgtatggattcaactttgattattcaacaaaatcatgaccgactgctgtggcctggagtaaccaaaggactgttttctctacacaaagtcaggagcgaataccaacctttatttgcacttgggttccagttcaaagccaccttagacagtgtggcaaagtgggaaaaagcacagatcctgggaccaaggttcagattccatctcaagcgagcatatgaactgtgtgacaacaggcagacagtacctctgtgtctatgagaaagcggggagagcaacaccccagcttctagcagctctacagctgcctggacctgcaggccctcctaggcccacttcctccccagcacagtgtgtgttcccgggcgtgtgtggctctgggtccagctctgttcagggtgggactccaggtgaattactgaacctctgaggtgtacccccaaccccaaactttcaccaaaagcaataaagaggaactctagaactggagccaggactaagtgagaaaaactgcttataagtgcttaataaatactagttatttacaacttttgctcaagccgagggcagaggcctttgtacgcagctgccgaactctgactctagttctgcggaagaaaaggatgcggtatttgcttttgccatgatccctttccatttgattggcaggttaaataacatggtttttgaagtcacatacttaatattcttcctaaaaaccacccaaacactagatgtgtgtgtgcacacacacagaaaccacgaggtagtttaaatcaccattaaaaatcaacgctttctctgattctgtgtcacagagtggtggccagtggctacacaatagcgatttttaaatgattggttaagtgaaaaccagaactcaaaatattccaggagagaagataacatttacaagtaaacagtaagtgcaattgtattttaatttcttggtctccgaaaactcagctgtgactgctttccattaacagttccagctctatgtgtttcctctaacgctaaaggcacagcccccgggaatctactgcttcctaagagtctccatggagtctattttacaacctcctttccctccatgcttccgcggaggagtctatactatctctatatacacattttaaacattattcttcatttgaaattccttcaataaaaacacagtcaccatt

SEQ ID NO: 3533 - DNA, 5271 bp, Homo sapiens
  ENST00000412285
gagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaacagcc

SEQ ID NO: 3534 - DNA, 5589 bp, Homo sapiens
  ENST00000375241
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 3535 - DNA, 2547 bp, Homo sapiens
  ENST00000375240
atgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcactctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccg

SEQ ID NO: 3536 - DNA, 2965 bp, Homo sapiens
  ENST00000375242
ccttttgctcgaagtcctttaatcgctaaggagctttcccagactcttccctctgcaggcccgctggcctctgacgcatgtcccctctgcggagcgtttgggcactggaggagccctggttggcacaggccgccccgcgttcccagctggggaaggaaggcgggcggccaggcggggggaaagaaagcgggaggtggggcggggtgctgtccgtccccacggcctcgtcgcgcgcggggctttttccaggacttggggacttccggggttgcgctgtcgtgtcaggccgttgggccgccgaggggtgtcgctgcgcccgctgccccgcgcggccctttaaactttgttttttaaacttcgggggtgtggtcgcggcgcctcccctctcggcggctggcagtccttgcctctgccccgccttccagatgctttggagtcatgagccgggagggcgcgggggcagctttggtagccgaggtgatcaaagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgct

SEQ ID NO: 3537 - DNA, 1734 bp, Homo sapiens
  ENST00000463569
ctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgcttctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatg

SEQ ID NO: 3538 - DNA, 689 bp, Homo sapiens
  ENST00000481149
tacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctacatagccagaatgcctttaataggctaatagcagcaaatctgtattctcttgagatctttcatctttgaaatgaagaccttaacagcgaagaggctttatttctgcagaagaatgtacaagaggcccacttgtggaacagcatgttgaagacccccagaaggcgggtgtgtccgtgtcacggggtccaccgccacccttctgtgtctgagctgcgttcttccttctctgaagctttttccttaactcatattttaagaatttcttctcttgtctcctcttggacttggaagttatgaaagaatgcaaaagttccttgcaagatctcttccaaagaaaaattccattgcaaccaactctggtactttgtggtttcactgagtattttcacatagctgagaaagatttaaaaatcaagctgatttcactcttcagaattaggcaaaac

SEQ ID NO: 3539 - DNA, 804 bp, Homo sapiens
  ENST00000452280
gatgctttggagtcatgagccgggagggcgcgggggcagctttggtagccgaggtgatcaaaggaaggaacattgcaatttttccatttcagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccc

SEQ ID NO: 3540 - DNA, 684 bp, Homo sapiens
  ENST00000415608
gctccccgccggggcctcgagaaggaaggtgtcacgttggtggcattcgagccagccggcaagacgaatgtccgggttgtcacttttgagaaatcccagccagccagagcagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattct

SEQ ID NO: 3541 - DNA, 459 bp, Homo sapiens
  ENST00000480920
ggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaagagagaccaagtctcgctctgttacctaggctgaagtgcagtggtatacatggctcactgcagccttgaacttctgggattaaatgatcctctctctt

SEQ ID NO: 3542 - DNA, 649 bp, Homo sapiens
  ENST00000496750
gtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaagtaagtcttcaaggatcatgttttcaactcttcctccccccgcccagctttattgaggggaataattgacaaataaaacttatatatacttaagatgtacaaa

SEQ ID NO: 3543 - DNA, 553 bp, Homo sapiens
  ENST00000463547
aaacccccgctgctccgtagccttgggaccctgggcgccgcgttgcccgtccggcgcgtaagcccgagcccctctcctgggcctcccgcgccctgccccctagcgcgccccccgaacgcctccgcctcccggggtccgctccccgccggggcctcgagaaggaaggtgtcacgttggtggcattcgagccagccggcaagacgaatgtccgggttgtcacttttgagaaatcccagccagccagagcagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcct

SEQ ID NO: 3544 - DNA, 350 bp, Homo sapiens
  ENST00000484948
ttatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggtaagtatttgttttcctaatgtattcataaaaatgcacacaacagtggttctttacatttgcagttggaattttgaaatcaagataatgtcttgatttctcttcagaaagaacgtgttttgcttttaaaaaattgaccaattca

SEQ ID NO: 3545 - DNA, 2181 bp, Homo sapiens
  ENST00000249014
gatccagcccgcggagcccgcggccagggcggcgcagaccggcccagcgactctcccgggctgccagccgggacgcgcggccgccgccgctgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctcccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtgaggggctggggcacggtcccagggccccacctaggtgcagagccggcccctcacctaacagctggttcctaccagaccggagaggggagaagtcatgttgcccctaaacccctccccacctctgcaggacagacatgggagggaggacagggaaggccaggcttgctctgggacttttatgctcccagaggccctgccaaactgaccacctcccccgactgccactctggacctaatagctgttccttaggccccactccatgccacccccaccagctggaggacccagcctcacagtgtgtcctttgtgccagaccaagcggcccgtggggggtggggggcagggagtgtaccacacagggccattgtctcacctcccaaagggaccgcctgcccccagctcatcccagagcgtccctgctgcaaccctgacagccgtctcccaggccgcttccccaacatccccgccccagcctccctcttaccccagaaaggtcaggtatgacctcccggggaggaatcccacctgcctgtataccccagacttgcctctggggcctgattaaataaggctgttttgataaaa

SEQ ID NO: 3546 - DNA, 720 bp, Homo sapiens
  ENST00000430687
gcagaccggcccagcgactctcccgggctgccagccgggacgcgcggccgccgccgctgcagacgacgagtccgccctcgtcccgcgcccccggggctcgcggagccagacggaatgttgctcttgttgccgaggctggagtgccgtgatgtgatcttggctcactgcaacctctgcctccaaggttcaagtgattctcctgccacagcttcctgggtagctgggattacaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagc

SEQ ID NO: 3547 - DNA, 588 bp, Homo sapiens
  ENST00000415670
agtattgagatttctatgcttggaggtggcagcaatggttttaaaaaaggaagaaggctgagccgcagacataggtgttcttaaggatcattattgacttttatcagctgaggtcccaggtctgtgtaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggaca

SEQ ID NO: 3548 - DNA, 564 bp, Homo sapiens
  ENST00000434728
ttgaatatgctcacgcatggaggaggcagctggaaaaagccacttttgaccacaggatccttattccaggaagctccttgaaggtggatggttcagaggaacctctgctctggctgtttacccagcttcacaaagctttggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccat

SEQ ID NO: 3549 - DNA, 5700 bp, Homo sapiens
  ENST00000295324
ccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgacccccccccgcgcgcgcgcccggccaccggttggccccgggccagggcacaggtaccgcggctgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcagtggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaagagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggggaggagtatggctgtgcattagctctactccctctctggtaagtactggggagagaacagccctgccagtactgggtttgatagattctaaatattaatcacacatcctgcctacagttagccattttagtttctgggagttctttcatgtacattttcttccattaattgaattaggtataattgagatggcaataaatatgcccgtattagaaagaggaaacaaagctacatgcggcttatgattttgttgagtcacttctcccgaggcagcctttccaatgcctggtcccttcccctgagagcaggtggactgctggtggtggctttctttcctgcagagaggcactttagacccatacctgctgtgagctgaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtataagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactactgtgctgcatttaattatcttccatttttgctgttaaaaaaaaaaaatccgttaa

SEQ ID NO: 3550 - DNA, 997 bp, Homo sapiens
  ENST00000457889
cgcgcccaccggagcccgggctgagagggacctggggagctgcggcctggccggggcggcgcactcaggtggcctcgcttccctgcgggtcaccgcccgccactcgcacagctaggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaaggg

SEQ ID NO: 3551 - DNA, 953 bp, Homo sapiens
  ENST00000453555
ccacaagcaaggctttgcctatgttttctcctggctccttctgcctcctgaccaaccctggtgcttccccgtgtggacccctgtgacatggcatgcccttcttgggagctgcagaaacgagtaatgtgagagcctgcaattgtaatcttcataaagtatatcacataccgttcaaaaacatcaagtggcatgttaaataagcttttggagaataagttgagcgtgacaccacaagaagaaaaacagaatccatgacttctcaaaacatgatcttgcttcagatgagaaagctctgtgcttagtttgctgtgagtacttctttgtgtccattgtggcctcctatctaacataaggattcctttccccaagtggtggaacagtgggtaggagagtctgttcatatcccaaaggtgtgccaaaaggatttatcaagaaggggatgacggaggttgctcttccaaaagcgtccagagtcactgagacctgacctgtgtattttgtatcctatccatgtcagcacttctccttgctgccaccgtgtgaagaaggacgtgtttgcttccccttccaccatgattgtaagtttcctgaggcctccccagccatgctgaactgtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgct

SEQ ID NO: 3552 - DNA, 542 bp, Homo sapiens
  ENST00000422687
gcagatcatgggggctcccttcgaattctgcctactgcatggaggatatagccttatcagtaatgtttcagaagtgttcccaagtgaaggcccagcctgtaatagagattcacaatgttttctctttgaagtgaagcagttttgttcatttcctcccatctcagaatgacttcaaatcctgacatcctcgacagcccaatactttgccacaacctgattacaactctagctctcttatttactggctatatgttattgagaaaaggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataac

SEQ ID NO: 3553 - DNA, 3726 bp, Homo sapiens
  ENST00000494083
atgccaggcattgtcctaaaacaaaagatgaagcacttctccttgctgccaccgtgtgaagaaggacgtgtttgcttccccttccaccatgattgtaagtttcctgaggcctccccagccatgctgaactgtgagtcagttaaacctctttcctttataaattacctggtctcaggtttgtctttattaacagcgtgaaaatggagtaagacactggggatggtagaagatgaggttagagaggtaggcacagccagggaatgacagaatatttttgtagtcagctgagtactttgtattttatcctgatggctatgagaagccacatgcggtggtccaatctatttgacttggtgactaatgggatctggggagaaggtgtaaaggaaccaggtgagatatgatgacagcctcaaccaaagatataattgacaaataaatggcctcatgtgatcccataggtttcactaggcaggagaagaaaatagaataattctcctatcagtaatattattctccaatgactactcggtaccttttttcattatttatgtaaattttattgcccctattcaatcatcaggtccttgaaggaagatcagagagacctgtgtctaattcatgtttgtgctgctcacactttctaacacagatcttgcacatatcaaagatgctataaatatatattgaataaatattaacacagaatttgtggggggtggtggtgccagagtcagtatttaaaccaagagaaagcccttcaactccctcctttgcagagagattactcattctgccatactgcacatccacaagacatttacagcctaccagagacctttaaagaaagtttcataacatccctgctgaccatctttttggagatggtgggtactagagtctatataatttctacaagattctaaagtagactgccagacattagaaaatgatctgaatttatgagtcagtcatccacaagagctacatgtttgtcagtggcagggccaaaatcaacaggaccttcttgccaaagtttcgagatacccactcacctatttattgatatctaagggttcagggtcatcaggattctctaaagtcatccatttgcaaacatgttccaagaccagcagtattttgtatatgaaagctatcttgcaatgtagactagctgaatgaaatgtctgtctttgtcatgaactttcatgttttcatttcagtaatgcaaaccacaacagtgctatgatcaaccctcatcatcagtatagaagaaattatctagtcctaacccatgttcttactggtttaatcatttatttccagctttctgctctttgtttattatttatgtaagatgttgtagctctgtatgctgagttaaaatgtaatcattttattaatattttttaaaaagttaaatttctaaccataaattataggatgattagttaaagacagaaatcagttttaagcaaaataactaagggcatatcctcttcccagcattttttattaaagaagtattttattttaaaatatttctagacttaacagaaaaattgcaaagataatacagagtcccacataccctatacccattctcacttattaacatcttacattaatattgtccatttgtgataagtaatgaaccaatattgatatatagtttttaattaaagtctatcatgtattaagatttccttagtttttaactaacattctttttctgttccaggatcccatcaacataactcattaaatttagtggttgtgtctctttaggcccttgtttgccatgactgttaagacttcccttgctttttatgaccttgacagttttgaggagttctcctgtcatttctcctcacatattttgtagaatgtcccctaattgggaattatatgatggctttctcgtgattaggctggagttatggatttatgagatgaagaccacagaggtaaaatgtcattctcatcatatatcaaggctgcgtactatcaacaagatttatgactgctgatattgaccttaatcacctgcttggggtggtgtttgttagttttctccactgtaaagttactcctctcatcttttatttgtattttatattattgttattatttgtttatttgttattattttagagacagactctcactctgtcacccaggctagagggcagtggtgtgatcatagcttactgcaaccttgaactcctgggttcaagtgatcctcccacctcgacttccacaagcgctaggattacagcccttctcccccactgcacctccccacatttttatattatactctggaaggaagccacaaggcatagcacacaattaagaagcagcgatttatactccactctttgatggcaaaatatctacagaaattatttgaacttcttctgcccgggagatttatctattgtcccccattgatttatttattcaatcatttgtttgtatcattatggtctcatggatatctattttgcactttcaatactattttattttgttgctcaagttgttccagccctggccatggagaatacattcagttggctcctgtgtccctgtaacatagccctgtcattattggatttggttgagcactttcttactttcaggagctacaaaatgctctaggttcgtcttgtatatttcctgctccatcctagagtccatgtctccaaggagcttggttcttttattggagaatgtattagaaaccaagacctggacatgctccttgttgcaaaggtgttattgcttctaggctcagctgacagagaaataacatatatgtgtgtaaattaacccatgtctatacacatatatctacaaatccttctctttgtaactatctgtatctatattaagctaaatatgagttgatactgatgtctccaatcccaacccagtagcacatagataattctaaccttctcccccttgcttgtttcctctccctcctacaatgaagaacctggcttctgccatcagccattcgtttatttcattgttcaattccagtctcctgtagagtacttccataattgttaagccatacccacatagaaataactttataagtttgagtgcttatacagagctctttttgcctttaatcttacagactcgattcatttccaaacttacttacgtaagcattttctctcacatccccttcagtacgcttatttcatgcatttgtaatacagttagattattttgccatattttacatttcatcctggaatcctccaaccttctaaatattttttaaattttgtataattaagtttctctatgccatgaagttctatgggctttgacaagtgcatagtgtcatgtatctagtattatcacaatatcataaaaagatagttttaccaccctttaaaaaatccctagtggttgacctattcaattcctttcaccaagagtttctgaaaccactggtctatttgccatctccataagagttttgccttttccaggatattacttaaatggaattataccttatgtagccttttaagactggcttttttcacttagcaacatgcatttaagattcatctatgtcttcctgtggtttgacagctcattccattgtgtggatgtgccacagtttatttagccattcacctactaaagtttacttctagtttttggtagttgtaaataaaactgctataaaattct

SEQ ID NO: 3554 - DNA, 5124 bp, Homo sapiens
  ENST00000611976
cgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcagtggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaagagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggggaggagtatggctgtgcattagctctactccctctctggtaagtactggggagagaacagccctgccagtactgggtttgatagattctaaatattaatcacacatcctgcctacagttagccattttagtttctgggagttctttcatgtacattttcttccattaattgaattaggtataattgagatggcaataaatatgcccgtattagaaagaggaaacaaagctacatgcggcttatgattttgttgagtcacttctcccgaggcagcctttccaatgcctggtcccttcccctgagagcaggtggactgctggtggtggctttctttcctgcagagaggcactttagacccatacctgctgtgagctgaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtataagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactactgtgctgcatttaattatcttccatttttgctgttaaaaaaaaaaaatccgttaatgatgtc

SEQ ID NO: 3555 - DNA, 3272 bp, Homo sapiens
  ENST00000335793
agtttgaaccgaggaggccgagcagtcgggcagaggttcccgacggccattggctgctgcggcgccgtgacatcagcgcagaggggtgcgcggggagggttgcgcggggcgggcgcgggcggagcctggaaggggagtgtcctggaggctcccagccctgaaagcccgagagccagagggaaacaaacgccggcgctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggcctttggggatctgacagatctgcctgtcgtgcccaaggccacgtacgggctgaagcatgcggagtccatcatgtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagca

SEQ ID NO: 3556 - DNA, 2879 bp, Homo sapiens
  ENST00000439510
acaaacgccggcgctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggcctttggggatctgacagatctgcctgtcgtgcccaaggccacgtacgggctgaagcatgcggagtccatcatgtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagc

SEQ ID NO: 3557 - DNA, 737 bp, Homo sapiens
  ENST00000581014
ggaaacaaacgccggcgctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcaccagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctg

SEQ ID NO: 3558 - DNA, 1022 bp, Homo sapiens
  ENST00000580315
agaaccgaattctccgcctgtacgggcagaggcgtgtacacatctcgctctcgtacacacactgcagcacacgccacccaatgtcacccggccgggaagccagagggaaggagctgtctggaagggaatggccgaaggaacaaatggtcctcctttcccctactcccgccccgcgaacccttccctcccccgccaggctcccgccccgcccgctccctcggaagcccgggaggccgaggcgcctcctggcggggtgcggggggagggcagtcgagccacccgcccccttggagccggggagacggccgctcctgggctagtgcgccccgagctcagcgcgctcagcgggatcgcaggcgggagcggtcggttaatgatttaatcgcccgcttggggcgggtgcgcgcggatcggccgtccctggccccgccccctctccggagcgcccccagccggggttacaaaactgccccctgcccccggcgcgtcccccaggagccatcctgcccgcggggatcccgtcagccgccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccg

SEQ ID NO: 3559 - DNA, 580 bp, Homo sapiens
  ENST00000579611
agagggaaacaaacgccggcgctgacaggggccgccagcccctccgccgcgcggagcccacgaaggggacagcgcagccggcccagagctcgggtctccggggaccgagtttcagggaaagtgtgtccgaggctactggaactctaaccagatttgcaaaatcactcctctactctgaatgcctgcggatgaagaaacaggcagggttataccatggattgctggcttatttcacagcatttaactttgccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatct

SEQ ID NO: 3560 - DNA, 539 bp, Homo sapiens
  ENST00000581045
aacaggccacaaaggaagggattgctgagctgcggatttctgatttctcccagaaatcgggagttggctgggactgagccaggccctaagagagcccctggcagccccaggggctcctggggcaataacagggcatccaccaggatctcctgaggctctatctctgctgagaagccagtgcctactgaatgcgggggtgccctgccggttcctgctctcatcaactgccctgtgtgagctgcacatgtgactgactgattagtggggtggcttatctcctctgaacttggactttgcctctccactccttgaagacagctgctccttcccacaaggggtgttcagtgaatttggggagatcccaagtggattcccaggcatcctggtggacccctgcagggactaggaggggcccgctgtgatcatatgggcggtggttctgggccttatgatctcctcattgcgtccccctctgcccactggacttggacttcagatctgaccccagacctgccggctacctcgggagggcccacctc

SEQ ID NO: 3561 - DNA, 660 bp, Homo sapiens
  ENST00000582303
actccttgaagacagctgctccttcccacaaggggtgttcagtgaatttggggagatcccaagtggattcccaggcatcctggtggacccctgcagggactaggaggggcccgctgtgatcatatgggcggtggttctggggcactgccagcttgcagctctgggctctgtgccaggatggcagtgctggcatccaaagccctcccttgccaggaacaggggaactggctgtctccactcaagctgaggaagggtctctcttttgggattcagatggagctgaaggcatctggaaaaaccacagtgccaggcaagaaggatccctggatgtctgtgctcagccagagctgcttcagccaccatcttctgccttggccatcacggtagcagaggttgtctggggcagcctccacctcccagcatgagactctgggttcttcttttgcccagacacctgcagttctggcagtcactgaacttggtctggagaccccagctttgaatctctccaagtgtgccaacaaagccaggttctgtgtgctggcttctctttcctgcctgtccttcctctctacctcgggtcttcactcagtgcaaccttcttatttccttacactgttgcctccaaccctgaagcatcagaaagggacctgttcccct

SEQ ID NO: 3562 - DNA, 572 bp, Homo sapiens
  ENST00000578516
agccagagggaaacaaacgccggcgctgacaggggccgccagcccctccgccgcgcggagcccacgaaggggacagcgcagccggcccagagctcgggtctccggggaccgaggaatggggtgtgtgtcggtgtgggcaggagcgcagcaatcggcggcgcgcggcccgcgatctccgcgaggggggcgtgtgtgcgcccggagttctccatgaataagaaccgaattctccgcctgtacgggcagaggcgtgtacacatctcgctctcgtacacacactgcagcacacgccacccaatgtcacccggccgggaagccagagggaaggagctgtctggaagggaatggccgaaggaacaaatggtcctcctttcccctactcccgccccgcgaacccttccctcccccgccaggctcccgccccgcccgctccctcggaagcccgggaggccgaggcgcctcctggcggggtgcggggggagggcagtcgagccacccgcccccttggagccggggagacggccgctcctgggctagtgcgccccgagctcagcgcgctcagcgggatcgca

SEQ ID NO: 3563 - DNA, 240 bp, Homo sapiens
  ENST00000630622
atgccaatcctcaagcaactggtgtccagctcggtgcactccaagcgccgttcccgagcggacctcacggccgagatgatcagcgccccgctgggcgacttccgccacaccatgcaccagctccctctccagctgcacctcaggcatcctggaggagcgcagccctgccttccgggggccggacagggcccgggctgctgtctcaagacagccagacaaggagttctccttcatggatga

SEQ ID NO: 3564 - DNA, 4889 bp, Homo sapiens
  ENST00000261769
agccaatcagcggtacggggggcggtgcctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccattgtcaaa

SEQ ID NO: 3565 - DNA, 4138 bp, Homo sapiens
  ENST00000566612
gcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacgttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaag

SEQ ID NO: 3566 - DNA, 2567 bp, Homo sapiens
  ENST00000422392
gctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctg

SEQ ID NO: 3567 - DNA, 2661 bp, Homo sapiens
  ENST00000566510
gctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaaggtttgtatggtacctggcaagatgcagaaactggcatcctcacagctgttcatacccttgtcccctgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctg

SEQ ID NO: 3568 - DNA, 2759 bp, Homo sapiens
  ENST00000562836
aaacacagcctgccaatcctggagaatgcctggtgggggtgctgggggaagaagtccaatttcagctgggaaaatgggacaggagccttgggagtgggtttacacctcaaattcccttatggccacagtccattggcccctagcctcctccccactttacagatgaagagactgaggtttagagagaggaacagccggcttggcagaggcaactgctgaggcagttgaggaaagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctggg

SEQ ID NO: 3569 - DNA, 969 bp, Homo sapiens
  ENST00000564676
cacttttaggttgggccaactgagaattttggggactttccttgctgtgaatgtggaattaaattgcttttttatttttattttttatttttcgagatggagtctcgctctgtcgccaggtacagtggcgtgatctcggctcactgcaacctctgcctcctgggttcaagcgatttgcctgcctcagcctcctgagtagctgggactacaggcaactgccaccacacctggctaatttttgtatttttggtagagacagggtttctccatgttggccaggatggtctcgatctcctgacctcatgatccgtccgcctcggcctcccaaagtgctgggattacaggcgtgagccactgcgcctggctgctttttaatttttttggaaaggtaggggggatttggtcaatgattaatccatctggagtttggtaacggatccagcagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacact

SEQ ID NO: 3570 - DNA, 581 bp, Homo sapiens
  ENST00000564745
gaagtgatgcaaaccagaccgtgcagccaactcctgcgtcaggttccataggaatcctttccccgccagtggaggaggctctcccgtcttttggaaatgatgtgcaggagacagagctgattctcatttcttccatggacacggctaagtgcgggctgtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaag

SEQ ID NO: 3571 - DNA, 736 bp, Homo sapiens
  ENST00000561751
cacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatc

SEQ ID NO: 3572 - DNA, 352 bp, Homo sapiens
  ENST00000567320
cagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaa

SEQ ID NO: 3573 - DNA, 282 bp, Homo sapiens
  ENST00000565810
aaaggtggctagtgttcctggtcctgacttggttgtgtcgatctctctgcagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtata

SEQ ID NO: 3574 - DNA, 952 bp, Homo sapiens
  ENST00000562118
aaaaaaaaaaagtacatacctaaataaaacccaagcagctctgctctcttcactcggcttgcgggtgtctttagttcactagcaattttattctggaatgagctttttattttcctcccctggtctcatcatttctttttattgctttctccagcccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttccctt

SEQ ID NO: 3575 - DNA, 2068 bp, Homo sapiens
  ENST00000612417
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtggcaggattgcttgaacctagtgatcctcccatcttggcctcccagagtattgggattacagacatgagccactgcacctgcccagctccccaactccctgccattttttaa

SEQ ID NO: 3576 - DNA, 3304 bp, Homo sapiens
  ENST00000621016
aaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaacttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgtt

SEQ ID NO: 3577 - DNA, 4878 bp, Homo sapiens
  ENST00000611625
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaaggtatggtacctggcaagatgcagaaactggcatcctcacagctgttcatacccttgtcccctgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccat

SEQ ID NO: 3578 - DNA, 3438 bp, Homo sapiens
  ENST00000264463
acttgcaaatcgctgtgtgctcgcagaagccagcacttccacagtctctaaccttcccatggcgagtgctgcagctctatcagcagaacctttctctccgtgtgaggaagagcttttttcccccctttccttttttttttttttcctttccccttaatcagaagcactgaatgaaagccaatcagagagagctcgcccccgttttcttcggttccctgctgtccagagttaaaagtgatgctgagaaagagcttgagttagattgaagtagaatcagtgatagaaaataacagccgaaaacaaacaaaaaggggacatagtgacaatttctcctgggttattttggctggaaccaacttccattatccagaagctgataaaaaagctttgggaaacatgaacaaaacattgatgaaatgttggaaaccagttgaaacacagtaaaaccaactgggtaaaataggaccacttctcttcatctacactgggatttgtcaagaagtgaactatgacaatacatcaatttttgctactgtttctattctgggtatgcctgccacatttctgctctccagaaataatgttcagaaggacgcctgtgccacagcaaagaattttaagttcacgtgtaccaaggagtgatggcaaaattctccatcgtcaaaaacgtggttggatgtggaatcaatttttcttacttgaagaatatacaggatctgattatcagtacgtaggcaagctacattcagaccaagataaaggagatggatcactcaaatatatcttatctggagatggagctggtactctttttattattgatgaaaaaacaggtgatattcatgccacaaggcgaattgatagggaggaaaaggccttttatactctacgcgcacaagctattaacagaagaactctgaggccagtagagccagagtcagagtttgtgatcaaaattcatgatatcaatgacaatgagccaacgttcccagaagaaatctatacagctagtgttcccgaaatgtctgttgtaggtacttctgtggtgcaagtcacagctacagatgccgatgacccttcatatgggaacagcgccagagtcatttacagcatacttcaagggcagccctatttctctgtggagcctgaaacaggtatcatcaggactgctttaccgaacatgaacagagaaaacagagagcaataccaagtggtcatccaggccaaagacatgggcggccagatgggaggcttatcggggacaaccactgtgaacatcacgctgacagatgtcaatgacaacccaccacgtttcccccagaacactattcatcttcgagttcttgaatcctccccagttggcacagccattggaagtgtcaaagcaactgatgctgacactgggaaaaatgctgaagtagaataccgaattattgatggtgacggtactgatatgtttgacatcgtgactgagaaggacacacaggaaggcatcatcactgtgaaaaagccactcgactatgagagccgaagactttatactctgaaagtcgaagcagaaaacacccatgtagatccccgtttttattacctaggaccatttaaagatactaccatagtgaaaatctctatagaagatgtggatgaacctcctgtttttagtaggtcctcctatctgtttgaagttcatgaagatattgaagtgggcacaatcattggtactgtaatggcaagggacccagattctatttccagccccattagattttccttggatcgccatactgaccttgacagaatctttaacattcattcaggaaatggatctctttatacatcaaaacctcttgaccgtgaactatctcagtggcataatcttactgttattgctgctgaaatcaacaatcccaaagagacaacacgcgtggctgtttttgtgagaattttggatgttaatgacaatgccccacagtttgctgtgttctatgacacttttgtatgtgaaaatgccagaccagggcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatttgttcattaattacattaattctttcctgtaggatgtctcatggaatatatatgacattttatttaatcacttccaagagccaaagctatggaaatacagtgttgtccatcttagtaaataaaagataatttcagaaacatgaacaggatagttctcccttaagcaacctcacaaacaagccgcttctgttaggtacatgtcctgcccttgcaaatgaagcttttaaaaaggtgaagaaaaattttacagtatatcctgttctgtacattaaattaaaaaaacaaaaatgtacatgtgatgttagtaggtgtgatatgcaacctggtatacagacatttgtgcaatttcatttcatcaaattctatctgctaatgttttatatttatatttttgtatttatttttaaaaaaataaaccagtttttacaacta

SEQ ID NO: 3579 - DNA, 1675 bp, Homo sapiens
  ENST00000502921
tagagatagggtttcaccatgttggccaggctggtctcgaactcctgacctcaagtgatgcacctgccttagtctcccaaaatgctgggattacagccacgagccatcgtgcatgagccagccagaaatgcatctctttatgtgagaactttgatgctgttgatttcagcatttatagcaaaagacaatcccaaagagacaacacgcgtggctgtttttgtgagaattttggatgttaatgacaatgccccacagtttgctgtgttctatgacacttttgtatgtgaaaatgccagaccagggcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatttgttcattaattacattaattctttcctgtaggatgtctcatggaatatatatgacattttatttaatcacttccaagagccaaagctatggaaatacagtgttgtccatcttagtaaataaaagataatttcagaaacatgaacaggatagttctcccttaagcaacctcacaaacaagccgcttctgttaggtacatgtcctgcccttgcaaatgaagcttttaaaaaggtgaagaaaaattttacagtatatcctgttctgtacattaaattaaaaaaacaaaaatgtacatgtgatgttagtaggtgtgatatgcaacctggtatacagacatttgtgcaatttcatttcatcaaattctatctgctaatgttttatattta

SEQ ID NO: 3580 - DNA, 2855 bp, Homo sapiens
  ENST00000510477
ccgttttcttcggttccctgctgtccagagttaaaagtgatgctgagaaagagcttgagttagattgaagtagaatcagtgatagaaaataacagccgaaaacaaacaaaaaggggacatagtgacaatttctcctgggttattttggctggaaccaacttccattatccagaagctgataaaaaagctttgggaaacatgaacaaaacattgatgaaatgttggaaaccagttgaaacacagtaaaaccaactgggtaaaataggaccacttctcttcatctacactgggatttgtcaagaagtgaactatgacaatacatcaatttttgctactgtttctattctgggtatgcctgccacatttctgctctccagaaataatgttcagaaggacgcctgtgccacagcaaagaattttaagttcacgtgtaccaaggagtgatggcaaaattctccatcgtcaaaaacgtggttggatgtggaatcaatttttcttacttgaagaatatacaggatctgattatcagtacgtaggcaagctacattcagaccaagataaaggagatggatcactcaaatatatcttatctggagatggagctggtactctttttattattgatgaaaaaacaggtgatattcatgccacaaggcgaattgatagggaggaaaaggccttttatactctacgcgcacaagctattaacagaagaactctgaggccagtagagccagagtcagagtttgtgatcaaaattcatgatatcaatgacaatgagccaacgttcccagaagaaatctatacagctagtgttcccgaaatgtctgttgtaggtacttctgtggtgcaagtcacagctacagatgccgatgacccttcatatgggaacagcgccagagtcatttacagcatacttcaagggcagccctatttctctgtggagcctgaaacaggtatcatcaggactgctttaccgaacatgaacagagaaaacagagagcaataccaagtggtcatccaggccaaagacatgggcggccagatgggaggcttatcggggacaaccactgtgaacatcacgctgacagatgtcaatgacaacccaccacgtttcccccagaacactattcatcttcgagttcttgaatcctccccagttggcacagccattggaagtgtcaaagcaactgatgctgacactgggaaaaatgctgaagtagaataccgaattattgatggtgacggtactgatatgtttgacatcgtgactgagaaggacacacaggaaggcatcatcactgtgaaaaagccactcgactatgagagccgaagactttatactctgaaagtcgaagcagaaaacacccatgtagatccccgtttttattacctaggaccatttaaagatactaccatagtgaaaatctctatagaagatgtggatgaacctcctgtttttagtaggtcctcctatctgtttgaagttcatgaagatattgaagtgggcacaatcattggtactgtaatggcaagggacccagattctatttccagccccattagacaatcccaaagagacaacacgcgtggctgtttttgtgagaattttggatgttaatgacaatgccccacagtttgctgtgttctatgacacttttgtatgtgaaaatgccagaccagggcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatttgttcattaattacattaattctttcctgtaggatgtctcatggaatatatatgacattttatttaatcacttccaagagccaaagctatggaaatacagtgttgtccatcttagtaaataaaagataatttcagaaacatgaacaggatagttctcccttaagcaacctcacaaacaagccgc

SEQ ID NO: 3581 - DNA, 1021 bp, Homo sapiens
  ENST00000503958
gagatatattgatgagatatatttttctttttctgcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatt

SEQ ID NO: 3582 - DNA, 6874 bp, Homo sapiens
  ENST00000394156
agcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctgggttgcccaagcttaatggaacccccctctcccagggaagacatgagattgctttatctgggcttccagctgatgctattttcctatgttaaagtaaacagaagattttgtcttctgggggtctttataaaacttcctttcctctatgtggtggctacagagagtccaaccacacttacgtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacgtataaatatcagtattctgacatgtaagaaaatgttacggcatcacacttatattttatgaacattgtactgttgctttaatatgagcttcaatataagaagcaatctttgaaataaaaaaagatttttttttaattctgggtttgattcttaacattgaaacaaacgttaagtatttctaatgatccatttatatttctaatttaattgtgatcttttaataaccctatttatgatctgttgttgtctgtctgctgcttttattgtttatttaaaatcaaatatgttttacaaatgttttttcagacaagattctgtaacatcatgtaaagcttttttgtacattcttggtgttaacctcctggcttctcttcacacacatcttctaaaaaagaaggatgtgaaagaactaggtcagtctatgactttgcaatatgtgttatatagtatgcatttatcttgtatatcagtaatttgatggttatgagagatgaatccatgagggaatggagctatcagaactctaatgttccaggtatacattctatgccccacactgagcactggggaactgggggactagagtcaaaaatataaatttgcccagactctaatgttattctattttttcttctgttgaacttaccaggctattgtaagactcttgatagttgaaactgcttatttttcctcctgtaattttaactaattgtaaaatgatgtggcattttatgttttaatgagaatgggcgattcatttaaaaaagctttgtttagaatatgcttggggccgtaagctcagaatgagggcagggaccattttggattctgagagtcgatgccatttggtccaggagtgtgtctacagtcccctgcattccagctagtttcttggggattgaaacttatgtgaagggcatttcacctgttcagttgggccaaaggtcaaaacgtagcaatacttggggaaagaccacataaagtcacactgcaagtgctttccctctttccccctacacacagggcacgtgctttttcttggattgcagacaatttttacagtttttttctgactttattgtgaaagtttgtttcaagcatttcttgatatcatgttatgtactatttttatgatttagtcaacatgcatacaaagaaatgttttttatgaagtgctcacttccattttactttgcattgaaatcaaattgggctgaacacttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaatacttgtttttctttttcttttttttttttttttttaccttttattttttcgttaagcctctattgtttgtagaacactcttagaaacttggaaataaaatgtctttcccaactagtggagtcctttttcatttggagcacattgccttaaaagaagtcttaatttaaacggtccttccttattctaaagtaatcactgttttataccatctatgcagctaaaagaaggaacatgcttctgttcttttcctcaagtaatggttattgtttctagtcatcattcattcattgattcattcattaattcatcaaaatcttattttataaaccctgttccacttactggaggattcagaatgaatcttactaccttttctgacatcttttgataattcagccctgtaccaaagtatccaccttgttgtcttataatcacctatttacctatttgccctcctagaaaatgcaagaagatattttctctccttccaaattgaaggaagaacataaaagatataacaggaaggagatggtgagatatagagtgtgagcggaaattaggccagctgtggcaattctggacagatcttgggtttagctaagttatttcttttaggcctgggtttctgggggtgacagggaagataaaagagtagtttatttgcacctcttggagaattgcttaaaaatatagagatcatggctctgtatgtcaggtggaaccaggtcaggagtatttgaaactgctcctgggtcattgtgacatatccttcacatctttttgagaaactttataagacaatgggggtgaatgggggctgggcagttggagtctctgagcagaagaggggcaaaatttatttggcaggcagtgtggaggacagattaggagcatataaacccagaggtgtgccccaggagggcttttgcaaaggtcaatatgagatagaatgagggcctgaaataattcagtaatttggagatggagaagaggaaagacttctctgctcttgcactgccatcagcctggtctgggccatggtcatctctgacccggaagactgaccccacctcttggctcaccctctgcctcccaacctcctcttcacaaagaagccagagggatacttttaacacacaacccagatcacatgacttcgtaacttaaacctcttcactggcttcccaaagacttaaaatgaattctgatgcctttattttattgctttacatgaacagggccctgcgaacctctccagtgtcattccactccatcctcctttcagtgcacgatgctccagccacactggccatctttcggttcctgatacaaaaaaaaacacgttccttttccatggaaagcaggtcacccttgttattttgtatcgatgacaactctttaaacttattttgctttttggctttatgtatgtgtgtgggtgggtgggactgactgccccactagaatgtaagctccatgagggcagggaatcttgctttcttgtttaccattgtatactcagttctttacacagtgcctgaaacataacaggtacacaataaatatctattgaatgaaagcaaa

SEQ ID NO: 3583 - DNA, 6857 bp, Homo sapiens
  ENST00000268603
ttctctcagcccccgccctttccttccctcacagcggcagcctccctcctcccgccccccccgccccgcacccgcctgcccgcccgccacctccccccggtttctcattcctgccactagcgcgctcggcggctcattccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacgtataaatatcagtattctgacatgtaagaaaatgttacggcatcacacttatattttatgaacattgtactgttgctttaatatgagcttcaatataagaagcaatctttgaaataaaaaaagatttttttttaattctgggtttgattcttaacattgaaacaaacgttaagtatttctaatgatccatttatatttctaatttaattgtgatcttttaataaccctatttatgatctgttgttgtctgtctgctgcttttattgtttatttaaaatcaaatatgttttacaaatgttttttcagacaagattctgtaacatcatgtaaagcttttttgtacattcttggtgttaacctcctggcttctcttcacacacatcttctaaaaaagaaggatgtgaaagaactaggtcagtctatgactttgcaatatgtgttatatagtatgcatttatcttgtatatcagtaatttgatggttatgagagatgaatccatgagggaatggagctatcagaactctaatgttccaggtatacattctatgccccacactgagcactggggaactgggggactagagtcaaaaatataaatttgcccagactctaatgttattctattttttcttctgttgaacttaccaggctattgtaagactcttgatagttgaaactgcttatttttcctcctgtaattttaactaattgtaaaatgatgtggcattttatgttttaatgagaatgggcgattcatttaaaaaagctttgtttagaatatgcttggggccgtaagctcagaatgagggcagggaccattttggattctgagagtcgatgccatttggtccaggagtgtgtctacagtcccctgcattccagctagtttcttggggattgaaacttatgtgaagggcatttcacctgttcagttgggccaaaggtcaaaacgtagcaatacttggggaaagaccacataaagtcacactgcaagtgctttccctctttccccctacacacagggcacgtgctttttcttggattgcagacaatttttacagtttttttctgactttattgtgaaagtttgtttcaagcatttcttgatatcatgttatgtactatttttatgatttagtcaacatgcatacaaagaaatgttttttatgaagtgctcacttccattttactttgcattgaaatcaaattgggctgaacacttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaatacttgtttttctttttcttttttttttttttttttaccttttattttttcgttaagcctctattgtttgtagaacactcttagaaacttggaaataaaatgtctttcccaactagtggagtcctttttcatttggagcacattgccttaaaagaagtcttaatttaaacggtccttccttattctaaagtaatcactgttttataccatctatgcagctaaaagaaggaacatgcttctgttcttttcctcaagtaatggttattgtttctagtcatcattcattcattgattcattcattaattcatcaaaatcttattttataaaccctgttccacttactggaggattcagaatgaatcttactaccttttctgacatcttttgataattcagccctgtaccaaagtatccaccttgttgtcttataatcacctatttacctatttgccctcctagaaaatgcaagaagatattttctctccttccaaattgaaggaagaacataaaagatataacaggaaggagatggtgagatatagagtgtgagcggaaattaggccagctgtggcaattctggacagatcttgggtttagctaagttatttcttttaggcctgggtttctgggggtgacagggaagataaaagagtagtttatttgcacctcttggagaattgcttaaaaatatagagatcatggctctgtatgtcaggtggaaccaggtcaggagtatttgaaactgctcctgggtcattgtgacatatccttcacatctttttgagaaactttataagacaatgggggtgaatgggggctgggcagttggagtctctgagcagaagaggggcaaaatttatttggcaggcagtgtggaggacagattaggagcatataaacccagaggtgtgccccaggagggcttttgcaaaggtcaatatgagatagaatgagggcctgaaataattcagtaatttggagatggagaagaggaaagacttctctgctcttgcactgccatcagcctggtctgggccatggtcatctctgacccggaagactgaccccacctcttggctcaccctctgcctcccaacctcctcttcacaaagaagccagagggatacttttaacacacaacccagatcacatgacttcgtaacttaaacctcttcactggcttcccaaagacttaaaatgaattctgatgcctttattttattgctttacatgaacagggccctgcgaacctctccagtgtcattccactccatcctcctttcagtgcacgatgctccagccacactggccatctttcggttcctgatacaaaaaaaaacacgttccttttccatggaaagcaggtcacccttgttattttgtatcgatgacaactctttaaacttattttgctttttggctttatgtatgtgtgtgggtgggtgggactgactgccccactagaatgtaagctccatgagggcagggaatcttgctttcttgtttaccattgtatactcagttctttacacagtgcctgaaacataacaggtacacaataaatatctattgaatgaaagcaaa

SEQ ID NO: 3584 - DNA, 2395 bp, Homo sapiens
  ENST00000566827
tgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctag

SEQ ID NO: 3585 - DNA, 436 bp, Homo sapiens
  ENST00000569095
gaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagcccgagcttcaaagccgactcagcaggcagcaggaaaatagaacactggatgattcttcaacatttaagtccatcttgggctgttaatatcaggaatggtgctatttgggcagatgaagagcatgtctgcccaggttt

SEQ ID NO: 3586 - DNA, 3639 bp, Homo sapiens
  ENST00000619158
gatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaaggtgagttagggtaaggaatcagacgtgtcagtggtatggcctgctctgccaaggcaacactgcaagaaacagggaggcgacggttaagaaatgagaatttgcgaaaccaggggctgacctgactttgtagttgagctctgagctctggaagatcacagaattgtattcctttctgttactgcagagaagctgacaaaggggctggtgatacctgcctgagattgctagttagttcttaaatgttttccgatggagggaagcacagttctcccatggagggaaggacaatgagataaatctagattttgaagaagcagccctgagcatgcatggaattccccccttagctctgccacactgaatctgttagataagctgttcagaactcttactgtttcaacattcaagattcactgcattgctggaccctctgtgaaactgaagccttctctacttgtttttatctcaagtgaacctggagaagcaacaataatggaccttctcccctagtcaaagagcctgtggacctcccctcatagtcagtctccaaaaacatgtatctggaattaatttattacaaagagaagtttagtgtttcttcttttttacatgcgctcaatactgactactggccagacacagcaccatcctcttacaaacatcatttcatttacttttcacaaaaacaaacaaaagtatgaagtaggtagtgttatcccaatgggcaaagagacctcaacttaattttgaggagattggggctcagacagatgaaatcatttgacccagtcactgtcatatagctcaggcatgccgacctggaattcacaccttagttattctagaacaacttccctctcaagacattttgaaaacagctggcctggaaagcgtttgtaaagaagagccagataagattcacttccaagtgaagaaataattcccgtacattctaaaaaggtttccccccgtgatttaccacttgagaaatcaacacctctccatcatgaaagtgtatggagcattaaatcggaattggaagatgggattaccttggttttaatcaagcgttcattttcaacttagttttatagcatgaatattaaactccttggtgcgatggaaaagactggactctaacactgatagaaaattaatttgaagcatcaataaagaggccagtagctaaagaggagggaaggaccagtgggggaagacaggtcctgaaaggaatctttcaggtgggggagcaaggagtgacctgtgctaagaaactgacctttcacagacttttaaagtatgttggggttggggaaaatattatagagcacaaaacaaagaaaaggtagggggtgattgttataaaaaaagaaagaaaatgaaggatatggaaattggggtgaaatttggatacttggaaaagtctacattaatggatgaatggtaggaccgaggaagcctaattatcaaccacagggagctagggcagtcactaattctggtttctcctctggaaaagtagctgtgtgaattgtgtgttgcctagagctgtcaacttacttcgttaattaatattactatctcttctgcttgacactgacatatgaacattgacatcagcaattcctgcctcccatcctttgctgttcatgtaattgggtagttggttatgctaaggttgtcacctgtttttagtgtattcagggcataaacacacactgtatctctgaaatcctgaaacatttaaatcacccccatggaactcacacgtcgcaaatgagctctctgcatatgattaatttgcacatttgcctccaattcagtgtgtttattctaggcaaaggaataatcttctataaagcactgatgcttaggttttaaatagtgtaagatgttattgcatttgtaaaagaacatttgctcaaacttctagcacaaagttccaaatgtccaccgggggaaaaaaaagaaaaattatagatgaatttaacagagtaaaaatatgactccttgtgaaagtcattccatgcaatttaatactgtaaaagtctatagagacattatggcaatatttctgcattttaaagtattttttaacttagtgtttttatttatttcctaatttattcacccatttttccaccaagagttattgagttcttactatttgtcaggcaggccctttgccagaggctggaaatctaaagttgaagaggcagagtcttgaccacagggagttcacaatttaacaggacagtgaagtgatacaataattaaaaccgagagggttttctcagccttagcagtgttgatgtctagggctggataattctttgttgtaggaggctgttctgcgcattgtaggatatttggtagtatctagtatcccaggcttcccctcactaaaggtcattaagcacgtgctctaccccacccaacagtcctgataataataataaaaataattactctagacattgcctaatagccctggagtaactgggagcaaaatcactccccagttgaaaattgactgcaatagtgtgataaggcctatgcacatgggacatgaatgacttcttgtgggggcagttctcaagctgagtcttgatagatgaggagaaatttgctggatagttaaggacagaaaaggcagaaaaaataactcatgatgggctagtatcaatggaaacaggacacatttaagaaactgcaataccttcaatcttgagaatcttaagatatatacggtaaaaccaacaaacaaacttgttaaaattcaagggagatgttacaaagaattgaagaaggtagaagaggtagtgagatagtagtgaaggagaagaattcaagaaataattactagatagaatcattcatttattgaatattttagaaaacaataaatacctcttgagttctgactgtgtcttagtttaatagtgcacaggaaagagagaaactacccttggggtatttggacaatctctgtgtggttagctgaggaagaaccagggtcaaataaagatgaggttttaggtggcttcgtggacttagaggggaaaatccaatctgttcacgcagcacctttgactaaatgggaatcccatctatctcagagaaatcaccgcacagtgtctgagctatttattttcaaccagataaactccttgaaaagcagtgtcagagcagaattataaggcatttttaatattccctgttttaataaaactctttttatgtttgatttttctttatattctttgtccgcacgtatatagatgtggatacataacatttaacacggttgcaatcagagggtgatctgatttgttaacttaatgtcacatcataaacattttacatgctgttatataatgtacataatcatttttaatgactacataacatcccatcctattgacgaatcattatgtccttaataaaatctcacagttgga

SEQ ID NO: 3587 - DNA, 781 bp, Homo sapiens
  ENST00000569128
taatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagtaagtaggtggacttggctttcacttttccatggtgacacagccagctctctccctcctctaacctattcctgctttactgaggtatcaaaaagaaaatctagaaaactaagggcaattcatatcattcttacaaaaacaaaacacaaaaacaagacaacaacaacaacaacaatgtcggggagtagaggtagtaggagaatgaaaagatgtaaaaagttctacaaccctggaaacaaaatatcgtttttgctaagtattttgcttggtagtagtgatgcaatctagtaattaattaacccttttctgcctcagtgtcctcatttctaacctggatataacagtccctgaatcagttatcaattactgtgtaacaaattgctggaaaacttagtggtttaaaacaataaaaataataacaataa

SEQ ID NO: 3588 - DNA, 1235 bp, Homo sapiens
  ENST00000567934
gctggcagtgccagggatcaggagccgcctctccgtctgtccagaacaaagctgggctgagccctctcacggtcctgtggcccttggtctccccacatgaggtgtcccgagattgaagagagaaggtgcctcctggcattgccaaggctggaatctgcctgtcaaggaagtccctcggcggctagctgctgcaccatgaccttcgtgatggtggagtgagtaggcactggaatcaataagcctggcctctccatctgccagcctgaatgcagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctaccc

SEQ ID NO: 3589 - DNA, 584 bp, Homo sapiens
  ENST00000569624
aagagcaaaactcgagtacctctgagggaaagccggaccccttgtccatcctctcctgtaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcagg

SEQ ID NO: 3590 - DNA, 568 bp, Homo sapiens
  ENST00000562998
tcattccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgac

SEQ ID NO: 3591 - DNA, 566 bp, Homo sapiens
  ENST00000564317
agactccatctgagccctgagggagtcggagcgccgcgccacggggcgggaggggcggccacgaatccagggaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagta

SEQ ID NO: 3592 - DNA, 613 bp, Homo sapiens
  ENST00000562712
tttatggtggcagcacaatgggcctttcagggctcagggaaagagctgtgagatcctgctccccggcttttcaaggcctctagtctttttatcaggcctggacaatgccggattcagcggctgcctgagcctcctgaccgtccattggccgtcagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtgg

SEQ ID NO: 3593 - DNA, 569 bp, Homo sapiens
  ENST00000562882
aaagctgggctgagccctctcacggtcctgtggcccttggtctccccacatgaggtgtcccgagattgaagagagaaggtgcctcctggcattgccaaggctggaatctgcctgtcaaggaagtccctcggcggctagctgctgcaccatgaccttcgtgatggtggaaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctcctt

SEQ ID NO: 3594 - DNA, 582 bp, Homo sapiens
  ENST00000562325
attcctgccactagcgcgctcggcggctcattccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccaggtgagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcct

SEQ ID NO: 3595 - DNA, 514 bp, Homo sapiens
  ENST00000568340
aaaactcgagtacctctgagggaaagccggaccccttgtccatcctctcctgttggaggaatgaggagttcaaaggccacgtccacacagagggtgacagaggcatcctctccgcgcaggacgcggactgggggcaggcacgcagcgccacccggatcctggagtcgtcaagaaaaacgcgggcgcgcaggccgaagaggaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactg

SEQ ID NO: 3596 - DNA, 542 bp, Homo sapiens
  ENST00000565210
agctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaaggttgctgaggtcagatggctatggtatcccaagtaacttatttgttctcaattcgcatcttggagaaagcacctcatcaccctcttgggggcatctccatgttcaaggcatgggtacccttagagttccacatggctggggaagcctcacaattatagttgaaggcgaggaggagcaagtcatatcttacgtggatggcagcaggaaaagagagagagcttgtgcagggaaactcccctttataaacctg

SEQ ID NO: 3597 - DNA, 468 bp, Homo sapiens
  ENST00000563492
accatttaccaaaggatgcctctagagcaggaagctttgagaagacctggggagcctggaacttctaagtctaaacaaggaactgactcagcagggtctggctatcttcagagtctgaggagaggcgcatcaaaggaatgacagcctggtacctttgatgaaggaactgacaggaaattaacagcctcgtgcaggcaaggacaaagacaagaaaaggcccatttgggcctcatatctctctggattggaacccgcaggaagcagaaggggctgtttaatcctggctccagagcaaccgtgaaggctggcttcctcccttgaagaagaacaaggtgaaggaaagaaatcactgtgttttcagctcagcggccctgtgacattccttcgtgttgtcatttgttgagtgaccaatcagatgggtggagtgtgttacagaaattggcagcaagtatccaatgggtgaagaag

SEQ ID NO: 3598 - DNA, 545 bp, Homo sapiens
  ENST00000563255
ctattaccatcaccatgcctcattagagtggggactttcggcggtggcttgggaagtacccaaagttttaggggttacagcagaggccaaaaaggcagacagaggaagcagggtagagctctgaaaaggttcagggccagggacccacagggggaggcaggagtggcaggcaccacgatctgctctctggcgctctacaggaaagcaccgggagtcaatgtcctcgcgcgtcccttgcgcagagtgtggtgcgaggttggggggttactggagacccagggggctatcaccttggacacctatggtggggggaaggctgaggagtaagataaccgggcagctggaaacttacagctcttcccccgcagtggaggaatgaggagttcaaaggccacgtccacacagagggtgacagaggcatcctctccgcgcaggacgcggactgggggcaggcacgcagcgccacccggatcctggagtcgtcaagaaaaacgcgggcgcgcaggccgaagaggaaatcactgtgttttcagctcagcggccct

SEQ ID NO: 3599 - DNA, 425 bp, Homo sapiens
  ENST00000564770
gatgccgcgggggccgctcgcagccgccgctgacttgtgaatgggaccgggactggggccgggactgacaccgcagcgcttgccctgcgccagggactggcggctcggaggttgcgtccaccctcaagggccccagttctgcaagctggaaagtctcgggatcaaggtgccacatgtctggtgtctagcaagggcctgttcctcatagatgatgccttctgagtgtcctcagttgacagaagagatggaaggggtgaaaacaggtgtatttcctcctttaagtcccttgataagggcattaatcctattcttttatagtcctctgtttgtagtcagtatcatcgtgtctccttctgggaggagatcatgaaaccatgttaaagaagcacagagaggggtacaaaggagaggctgagactaagaca

SEQ ID NO: 3600 - DNA, 539 bp, Homo sapiens
  ENST00000569783
cggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaattacatggctgctttgtaaagattctggtttggggaccctcatatgggaaacgccatgacattgacctcgtggtctgatttacaatgccagtactgcgctcccaggagcatagcatgtcctggaaccttgcctgtgaatgcctgtgacttatgaagtggtaacttatgaagttggtaaactttgatctcttatattcaaatctgttttcagaaccatctaaacaagatcttcaaatctgattttagtcttccttcattctcaatacatgtatgtaggtagatgttggagaaacataacaatttcattggaatttactttcaatattgatgttttcactttgatgacaggcatacttact

SEQ ID NO: 3601 - DNA, 2199 bp, Homo sapiens
  ENST00000539548
tttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaactgatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttac

SEQ ID NO: 3602 - DNA, 583 bp, Homo sapiens
  ENST00000566333
ttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtaacacatctgtttgagataacttgggttcaaggaggacattaggttctgtctgtcttatgtggaaaatgggtctttaatttattatgttggct

SEQ ID NO: 3603 - DNA, 535 bp, Homo sapiens
  ENST00000569455
agtgcagccgcgtgcatgaatgaaaacgccgccgggcgcttctagtcggacaaaatgcagccgagaactccgctcgttctgtgcgttctcctgtcccagtagagacgggttttcaccgtgttagccaggatggtctcgatctcctgacctcgtgatccgccagcctcagcctcccaaagtgctgggattataggcgtgagccacagcgcccggcctatcgtgccctttcaacagatgaagaaactgggccaaacaacccacctgcactgcatggttcccccagcaagaacatcccagtgagaatggcccacagatgcctgggcgtgacccacctgcagcttcaaccatgcaggctgaagtgcagtggcgtgatctcggctcactgcaacctccatctccagagttcaagcgattctcgtgcctcagcctcccaagtagccaggattgcagggccaagatgtctaaagttgaccttcagtctagtccaacatctggaaatgagtactaaagccaccagcacagacaaaaatggaga

SEQ ID NO: 3604 - DNA, 1456 bp, Homo sapiens
  ENST00000567445
agtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaag

SEQ ID NO: 3605 - DNA, 877 bp, Homo sapiens
  ENST00000569454
agcagagctgccaaccagagcctctgatcaacacaggataaccagcaggagagttggtggaattccagacagtgtgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagag

SEQ ID NO: 3606 - DNA, 539 bp, Homo sapiens
  ENST00000562307
ccaaccctatgactctgggttctggagaggtgaaagagcatctccaggtggctcaaaactgtggctccaggtactactcctccaggcgggctgctccctggggcacgtgttctcagtccaccagtgggccatgccgcatcagcccacctgcttcctggcacatgggatgcacagcccatgaccttggacccagcagtaggcagcatgctttccagttttgaaggcaaggacggaggcatacaaggcactacttgagatcctgtctgatttagaattttgtaggacggattcctgttgttgaacacactgagtgatgagaaacttggcaaatcttgttggcaaatctctcaccttgattccctttggcatcctttgtgtctgtctgatccttccagcctggcctttggatagcaggtacccacttcttaggatgtgccagacaccacgtttcaagccacagtcgaggaaggagctgtgggagttattgtcaatttgacagttgaagataaggatgaccccaccacaggtgcatggagggc

SEQ ID NO: 3607 - DNA, 8042 bp, Homo sapiens
  ENST00000567109
aagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaactgttctctgatttctatcttgtgtccaatgtcactgatgttgggtcttgtcttagtgcaagttcacatttttgacagaccatttggggtccgtcgtacatctctggttggtgagtgagtctatgaagacagaagtaccagttctcagcatgggccatggactcatcttgtccacctcatgatatgatctgagggtgtcataatcagctataaaggtaattgcatactcaaagatgagacggaccattctcagttgatgaccacattaagcatagtcatggccatctgtcaacagtcccaagacctggggatttttctctggaacaaatcctgttgctggatcaggagatgccacaccttgaacttgatagggtcattctccacgagcacatgcccccgactcagggacaggggaatctaagcctgtgcattcacactccacaagatttcctctactggctttacagggcactgtcacgcgtctcccgggcgcaccttgctcccctcttcctgcaaggcagggggagaacgttcatccttgaacaaacaaagagcatcctcagccagtcaggcggctggtagccggacacatatgctaactggcaatcaggaagtcaccctccaatgtaaacttcagccacatgcagggagaaacacagcagctgagtggccattcactcaaggaaacaaatacagcatgactccttttctctcaagctggtaggctctcctgcactttgtgaaccgaaccagaagattaacttcgctgaaaattcagaaaaataggagtaaagtgcacacttcattaataaatagaatatgcctcaactttcccttatttaaacatattctctgtccccacagttctaatcaggacagagatacttctgtcatgttgttcctcctaatagtttccagaaaaaaaggaaaataaaccaattcttataggccaaagtggtagcatttcctgaatcataagatgttttgttcatttgctggaatatattacattgtttactgaaaaccatagtagaatcaaaatgttatttcattattacctatgcattttatctgagtccaacttattaaaaaacgaagtcaagtaaggaccagaaattgcttttcccaattactgagcacaggtctgagggttttatttccactgagcaaatagtcacaccttcacttctttttattaatactcaaccaacttagttgattaaaaatcacattttctccctcattttacatacgataaattaattattttggataatttgttttaataagaatatgcacacattttctaatttcaataaaagtcaccttcaataccgccagttctctccaaatgagcatcattccaggcagatatacctgctgtgcctcttggccgacaccagcaaatctaagcattataacgaaataaatccagccagatttcatggtaggtatcaaataagactttggctcttaaagaacatcgttagaaattttgatagctcattccagagtttcagaatgtcatttaaaacagtctgataaatggaacaaccatctaccatcacactcatagagtagctcaaattgcattttacccaaataaatacactgggtcttaatcttaagatgtgacaactaaaaaatttttaacaagtctgtgtttgatcctggatttagtgcagttgcacccaggcacgagctctccagatgattctgaggaaaggagtctacaattttcctagggggtgtatgaacatggtaccaaaaaggtgattaataattataataatggtttatatttatcaactgcttattatgtgcccacactgtacaaaatccttacagatagtaactcattaatccctccagtaacatatgagacaagcactactatcttctccaactcacagataaagaaggctgaggctcagaaaaattgaatggcttgcccaaggtaagtggcctccagaaccaaacctcaggctatctggctccagggttcatgttcttccgacaacatcacaatgccactctcaacccaggagcaaaaccagacaaagtgcctactgcagaccggaagaccctcgtttgaagcctccattagcgtgactatgcagctagaccaacttactgttaagcaacagtaccttttactatgaggtaccctttactattaagtaccttttactaacagtatcttctgttacctattattaagttcatgctatacttcttcaatctgaaagctttctgttaaaaaaaaaaatgttaacatcgttctaaattaatattgagaccttagaaatttttcctgtgcaagataacgtaattatttgccccttcccttccatggcttgttagcaggtagatgaggggcttctcctagattaatttaacatctcagttaatcaaaagtagccgggcatggtgactcatgcctgtaatcccagccctttgggaggcagaggcgggtggatcacttaaggtcaggagttcaagaccagcctggccagcatggtgaaaccctatctctactaaaaaatacaaaaattagctgggtgtggtggtgcacacctgaaaccccagctactcaggaggctgaggcaggagaatcgcttgaacccaggaggcagagtttgcagtgagccattgcactccagcctgggcaacagagcaagactccgtcaaaaaaaaaaaaaaaaaaaaagaaagaaaaggaaatttatgaactccagagtacccattcactaccaaaccaactgaggggagagaaaactgagggagaaagtggggtggggtctcaaagggtttgcactgtgctttgctataaatcattcaaaggggcaaattctaaaggatctctaagtagttgctgattttgtaaaggtagcccataaatctgtttacgtgtagctgccttaaacatgagtcaacagggtaagtcacaccaacaggaaacccaagcactaaaaaagccacctaccttttctgtttaccaaatactaagaataataatctaataatctggctacatctttcataaagacctccatcttctctccttaactgactgttgagatttgataattttcacagtctaatgataaaatgctttcaaaatggttcatctaacacaattaacaattcttttactatatgcaatgtgttacccttactatatttcctattgctaatagattagcccactattgaaaaaattctgcagttgtgaccgtgttcacatgaaagcatatacaagacatggagagacagcaaaaaatggtgggaatgggtgtgtgtatgagggtttcagataagaacttcaattatataatttaagaagagtcagtctataatttaagcagaaataattgagatactcatcaaattaagtaagcggaaaaatttcctctctctcatactatgttgctatcatcacatctatcgttggagggttgctgagcttgatacgcctttgaaccattttatttgactttccacgtgccgtctcattggtagggagatggtgaaaagcgttgggtggtgtaggacgagggaggttttcactctgaagctatgaagatttggagaaaggggcttatagaagcactatgaaaataaactggagactatttttttgctactttttaaaaagctttttctttagagagtactaaagccattctatatctgtcgtacacatgaattcagactattattagagagttatatctgtgttgtcatgcacatgtcaacactgtcctgatgacaaaattttatgtatccccccagataaaaattttaagaaattttaaatgctttttattcacacacacttttcaaaagggataaaagttaatcatgttaaaatattcagtctatggcagatgtcgctcctttgggccctcactgctgaattgcttacagtttctgagctgtaaactaacatttgctttactatgtagttacagagaaatgtgcaacttgtttgtgaaacattcaaataaagcttatctgggatttttaa

SEQ ID NO: 3608 - DNA, 2722 bp, Homo sapiens
  ENST00000268613
atctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccagggccaaacaacccacctgcactgcatggttcccccagcaagaacatcccagtgagaatggcccacagatgcctgggcgtgacccacctgcagcttcaaccatgcaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggtta

SEQ ID NO: 3609 - DNA, 583 bp, Homo sapiens
  ENST00000569144
tctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaactatgtattctactagctgacagacttttaaagtagaggccacttttaaaagcctgggctcccatgagaaggaaatctgcagtagacaaagcaagatgcttagttaacagcagcaacccagtgcctgtaattttcaagtccttggaggcacaccatgtcacccaagtgaccttcagtgactgtaagggaaacgacaagctacgctatgaggtctcgagcccatacttcaaggtgaacagcgatggcggcttagttgctctgagaaacataactgcagtgggcaaaactctgttcgtccatg

SEQ ID NO: 3610 - DNA, 545 bp, Homo sapiens
  ENST00000562601
tatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcg

SEQ ID NO: 3611 - DNA, 589 bp, Homo sapiens
  ENST00000568770
atttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccagtcaggtggtcctgtgtgcaagtcccagttccaggcccttccactggctgtccaatggcttggagtctgaggctcagttttcccacttgcagaaggaaggaatgatgccaacttcgtgctgctgctaacatctgcagaagatttggactgcactcctggatttcagcagaaagtgttccatatcaatcagccagctgaattcattgaggaccagtcaattctaaactatggtaggaaatctatgccttttggattttcatccccaagaaccaccttcaaaagaaagaaatggaaaagcataaaatcaagtgaccttcagtgactgtaagggaaacgacaagctacgctatgaggtctcgagcccatacttcaaggtgaacagcgatggcggcttagttgctctgagaaacataactgcagt

SEQ ID NO: 3612 - DNA, 810 bp, Homo sapiens
  ENST00000565636
tttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaagatgaagatttggcaagttctgtgcctagcacgatggctgacatgagataaaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccacta

SEQ ID NO: 3613 - DNA, 831 bp, Homo sapiens
  ENST00000431540
tttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaagagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccactagcactcggtatttcaaatccattttctctacagaatgatgtgtttaaataaattgtcctgttgactgaa

SEQ ID NO: 3614 - DNA, 2195 bp, Homo sapiens
  ENST00000428848
tttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacag

SEQ ID NO: 3615 - DNA, 1246 bp, Homo sapiens
  ENST00000521087
actcagcctggacgcgcttcttcgggtcgcgggtgcactccggcccggctcccgcctcggccccgatggacgccgcgttcctcctcgtcctcgggctgttggcccagagcctctgcctgtctttgggggttcctggatggaggaggcccaccaccctgtacccctggcgccgggcgcctgccctgagccgcgtgcggagggcctgggtcatccccccgatcagcgtatccgagaaccacaagcgtctcccctaccccctggttcagagcgagatgccatctcaaaaggtaaaaaaaaagaaaagtaactttgtacttgatgtggggaaaggacgcttcctgcctttgcctctgcaggaagcaaaatttccttttatttgccccaaatcctcctttagactttgagaaccagtccttgtatcccttacatcaaaagttattagagagtatttctcacttggaaactgtaattgtgcccattctccgaaaggatgggaggcagtttaaaatgtcatgtgcacaggggaattaaacttcaggaggaggccaggcgcagtggctcacccctgtaatcccagcactttgggaggccgaggcgtatcacctgaggtcaggagtttgagaccagcctggctaacatgatgaaacctcatttctactaaaaatacaaaaaattcgctgggcgtggtgacgtgcacctgtaatcccagctacttgggaggctgaggcaggagaatcgcttgaacccaggaggcagaggttgcagtgagctgagatgtcgccattggactccagcctgggcaacaagagtgaaactctatctcaaaaaaaaaaacaaaaaacaaaaacataacttcaggaggaacaaagaccacagagagacagggagagagattaggaaccctctgagagccttactttagtcacacgtgaagctgtgagcttcctggctgccaaggcaagcagggaaagtggcacctgccctgtctgctaagggaaggtggctcccgttcagggacgtcctcagtcactgtgacagatgccccaccctgtgctgtttctcgcctgtttaagctggtgtttccagctggagacaaagtctgaacgtgctgtctctttcgcatggccctaacgggagccacagaaatttgggggccacagagccagcccttgctctatgtttgaacagctaagagcgtttgccctggacctgggaggatccaccctggaggaccccacggacctgg

SEQ ID NO: 3616 - DNA, 1587 bp, Homo sapiens
  ENST00000524089
actcagcctggacgcgcttcttcgggtcgcgggtgcactccggcccggctcccgcctcggccccgatggacgccgcgttcctcctcgtcctcgggctgttggcccagagcctctgcctgtctttgggggttcctggatggaggaggcccaccaccctgtacccctggcgccgggcgcctgccctgagccgcgtgcggagggcctgggtcatccccccgatcagcgtatccgagaaccacaagcgtctcccctaccccctggttcagatcaagtcggacaagcagcagctgggcagcgtcatctacagcatccagggacccggcgtggatgaggagccccggggcgtcttctctatcgacaagttcacagggaaggtcttcctcaatgccatgctggaccgcgagaagactgatcgcttcaggctaagagcgtttgccctggacctgggaggatccaccctggaggaccccacggacctggagattgtagttgtggatcagaatgacaaccggccagccttcctgcaggaggcgttcactggccgcgtgctggagggtgcagtcccaggcacctatgtgaccagggcagaggccacagatgccgacgaccccgagacggacaacgcagcgctgcggttctccatcctgcagcagggcagccccgagctcttcagcatcgacgagctcacaggagagatccgcacagtgcaagtggggctggaccgcgaggtgaggtggcgccccggcagctccacacccgcacggccagggcagcccatctcctgcgggtccctctgcccccagcctgcccaccccagacgctcctgtccctgccgtcactgcagagcttgcagtggccctggctcctgaggagatggcatggggtgaacccactgatgcgcagacaggagccgcgctggcccgggtgggaggggtctggtgcaagtagggcgtgaggggcccggcacagggcagggctccccaagcagccccgcccctctcagcctcatggcaacggctccccgctggtaagtaactaactccttctgtcagggcccctgttgccccttgctgtcggacttcggtgctcccggaagaccccccttgagtcagctcctctaggaagccctcctggttacactgttacgtggtctttgtccatttctgttcctgccactaaccacggttccccagggcagggacccaagctcactggtgtgctaggtgcccagcacagagtaggtgctctgtaaatgcttacccagcgcacagtaggtgctctgtaaacacccagcgcacagtggtgctctgtaaacgcttatccagcacacagtaggtgctctgtaaacgcttacccagcgcagagtaggtgctctgtaaaggcttacccagcgcagagtaggtgctctgtaaatgcttacccagcgcacagtaggtgctctgtaaacacccagcgcacagtggtgctctgtaaacgcttacccagcgcacagtaggtgctctgtaaaggcttacccagcgcacagtaggtgctctgtaaacgcttacccagcacacagtaggtgctctgtaaacgcttacccagcgc

SEQ ID NO: 3617 - DNA, 2847 bp, Homo sapiens
  ENST00000289746
actcagcctggacgcgcttcttcgggtcgcgggtgcactccggcccggctcccgcctcggccccgatggacgccgcgttcctcctcgtcctcgggctgttggcccagagcctctgcctgtctttgggggttcctggatggaggaggcccaccaccctgtacccctggcgccgggcgcctgccctgagccgcgtgcggagggcctgggtcatccccccgatcagcgtatccgagaaccacaagcgtctcccctaccccctggttcagatcaagtcggacaagcagcagctgggcagcgtcatctacagcatccagggacccggcgtggatgaggagccccggggcgtcttctctatcgacaagttcacagggaaggtcttcctcaatgccatgctggaccgcgagaagactgatcgcttcaggctaagagcgtttgccctggacctgggaggatccaccctggaggaccccacggacctggagattgtagttgtggatcagaatgacaaccggccagccttcctgcaggaggcgttcactggccgcgtgctggagggtgcagtcccaggcacctatgtgaccagggcagaggccacagatgccgacgaccccgagacggacaacgcagcgctgcggttctccatcctgcagcagggcagccccgagctcttcagcatcgacgagctcacaggagagatccgcacagtgcaagtggggctggaccgcgaggtggtcgcggtgtacaatctgaccctgcaggtggcggacatgtctggagacggcctcacagccactgcctcagccatcatcacccttgatgacatcaatgacaatgcccccgagttcaccagggatgagttcttcatggaggccatagaggccgtcagcggagtggatgtgggacgcctggaagtggaggacagggacctgccaggctccccaaactgggtggccaggttcaccatcctggaaggcgaccccgatgggcagttcaccatccgcacggaccccaagaccaacgagggtgttctgtccattgtgaaggccctggactatgagagctgtgaacactacgaactcaaagtgtcggtgcagaatgaggccccgctgcaggcggctgcccttagggctgagcggggccaggccaaggtccgcgtgcatgtgcaggacaccaacgagccccccgtgttccaggagaacccacttcggaccagcctagcagagggggcacccccaggcactctggtggccaccttctctgcccgggaccctgacacagagcagctgcagaggctcagctactccaaggactacgacccggaagactggctgcaagtggacgcagccactggccggatccagacccagcacgtgctcagcccggcgtcccccttcctcaagggcggctggtacagagccatcgtcctggcccaggatgacgcctcccagccccgcaccgccaccggcaccctgtccatcgagatcctggaggtgaacgaccatgcacctgtgctggccccgccgccgccgggcagcctgtgcagcgagccacaccaaggcccaggcctcctcctgggcgccacggatgaggacctgcccccccacggggcccccttccacttccagctgagccccaggctcccagagctcggccggaactggagcctcagccaggtcaacgtgagccacgcgcgcctgcggccgcgacaccaggtccccgaaggcctgcaccgcctcagcctgctgctccgggactcggggcagccgccccagcagcgcgagcagcctctgaacgtgaccgtgtgccgctgcggcaaggacggcgtctgcctgccgggggccgcagcgctgctggcggggggcacaggcctcagcctgggcgcactggtcatcgtgctggccagcgccctcctgctgctggtgctggtcctgctcgtggcactccgggcgcggttctggaagcagtctcggggcaaggggctgctgcacggcccccaggacgaccttcgagacaatgtcctcaactacgatgagcaaggaggcggggaggaggaccaggacgcctacgacatcagccagctgcgtcacccgacagcgctgagcctgcctctgggaccgccgccacttcgcagagatgccccgcagggccgcctgcacccccagccaccccgagtgctgcccaccagccccctggacatcgccgacttcatcaatgatggcttggaggctgcagatagtgaccccagtgtgccgccttacgacacagccctcatctatgactacgagggtgacggctcggtggcggggacgctgagctccatcctgtccagccagggcgatgaggaccaggactacgactacctcagagactgggggccccgcttcgcccggctggcagacatgtatgggcacccgtgcgggttggagtacggggccagatgggaccaccaggccagggagggtctttctcctggggcactgctacccagacacagaggccggacagcctgaccctggggcgcaactggacatgccactccccggcctcgtggcagtgatggcccctgcagaggcagcctgaggtcaccgggcccgacccccctgggcctggggcagcctccttcctgtaggcgagggcccaagtctgggggcagaacctgagtgtggatggggcggccaggaagaggccccttcctgccggggtgggaagagtttctctccatcggccccatgcgggtcacctccctagtcccacctttgcctcctaccagtgaacctcatctttgtatgaaagacagcaacctcctgggtaaatctgaatgaaaaacgtgctagtctctttcatgca

SEQ ID NO: 3618 - DNA, 6341 bp, Homo sapiens
  ENST00000262150
tgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttccctggagtaaatactccatggttattttaagctacctacatgctgtcattgaacagagatgtggggagaaatgtaaacaatcagctcacaggcatcaatacaaccagatttgaagtaaaataatttaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgtttcctttatttaaaaaaaaaaaaaaaaaaaaagaatgctaggtaatcttcgtagaaaactagaaagtatgataaacaacagttggaggaatccatggaaaatagacgagaaaatgtaaataaggctttctggggatcacagaacttttgtatgaataaaagccttataaaaccagctctggcatatgactaaaatattcctctactatttttcaatgtcatctaatgcaaacgctcaacctttttaaatggttaatgtgagaaaggcactgaattaagatatcttagtgttattttatttactcaattttcatctttcacactgtaagaataaaatgtttttgtggttaagttcctgatactatatagagataaactttaaaactttaacacctaggataatgtgggtgattacataaatgtttaaaaacatttaccttatatggaaagcagatttctgactaagatgccatgattcattctagtttgatattttaaaactttgccaagagcactctttaaaactgatttcaaatttgaacagatacttggtgtatacaaattaatcagagttatatagtataaatttgtattatttttgatattacaactttgtattaaaaaggaaaatatatttaggtgtttgtcatagattttttttcatatgcaactcaaaacacattcttatgtcaaaatacaatagcaaaatacaagtcaatatttactcataattaaatgcaaactttatgaaactggtggaaagtgtggaaaaatttaagtaaatttttacctctactaaaaattatttagacaacttaaaggaatactggattcaaacttcagttactattcactgtaaatattatgatcaactgaactgacttaccattcatgggataaaacatgatacaattctcagtatttgcttttctgttaagagcttggaatatgactgatgcttcagtgtcatttttttattattgaatataaaattaggtgcaatagatacatttattgtagccttaagaaggaaatcaatgctaagctgttgggcataaaactttacagtaacattagataacaagataataaaacactttaattttaatcgaccttttaagaatgatctttattattctatccaaatcaaggtagacttcaaaatttatggtttgaacaggaagaaagtagtgaatacaaaattcttaaaattggttcatatgatcatttttttattaatagcatgtgagactaagctgaaccaaactggccatatatgttaaatcaaataatttgagtaattttgaaatattgatgaagtagttaaatggttataatatattttattggtactttgaaatttaaacatctatatcacataataaagaaagtttttcatcaatctgaaacaggcaccattaaattggtgacacaaatattatcatttcacaaaagcttgagaaaaccagatttgaagtgaaataatttaggaagatattaaaagtggatgagaggacataagatgtagtcaatccttaacgcaatgataccattattaggaaagaggaaaaataccaaacaagagaaaatttaaaggagcaaaaatttgcaagtcaaatagaaatgcacaaatcgagagaacatttacatttctatcacattgacatgaaaattgaaaatgtatagtcagagaaattttcatgaattattccatgaagtgttgtttcctttatttaaaaagaatgctaggtaatcttagtagaaaactaaaaagtatgataaacaacagatggaagaattcatggaaaatagacgagaaaaagtaaataaggctttctggagatgacggaaattttgtatgaataaaagccttataaacaatgaatacatttggataaacaactcattaaaatgcacattaatggaatacctgtacaaatagttttaatacttgtgtccagtggcactaaagagatatattaaaatagattctggttgagttgattataagattgtcaatcataggatacacagggaaagcacagacacgattgctcatctctttggtagtctaaaatatgttccttttaaccacatcaaaagatactatctgattctaatacagaaggtgcaacttcctaggaattatactttgtattatattcaataattattttatgttttgcatcacatgggtgttgcaagaacacagctcttaaactaaaaaggcattacattaagaatttatttttgtaaattttaataaactctaaattaatgcaaaatatttatgaaaatagcacagcttcacattaatacccacagtacttaaatatctcccttagttgactcacagctttgtatgtaagcttcaaatttttaatggtaaaaataagaaaattaggactagcgaactgctagttgttccctcagtgcatgtgcttgagcctaacagatctttgtttgaattagttactttcaattaagcgaacatataatatttgttaaactgcttaatctttccagatctcactttgtaaaatgacgtccaatcaacctatttcacatggttgttatgaagaattaataataagatatgtaaaaccagcagcaccaatagtgcctgacaaaatataactgctcaataaataacagtgaattattataacaacagctaatggtattctattggaacacatggtctgtttcttttccaattctgagtgatctcaacagcctcacggcacattgaaaataaaagtcaacttcctcaccttccccataggccatggactttcccatctctacccacttgtgcagtttctcctctttcctctctcctcctcagttactaaagcaatcttccttcaaacacttctattttccattacatcacttcattcaggttggtgatcagctgcaacttcctcagaaagaccactgctgcttccagtgaccctggctttgtcttgctttgtattagattactcagctccctggtattattgttgtctttatcgcttattagaatgtaacccttaatgggcaagaaattgtcagtcttgttcatttatcatcgtataaaaaatgtttctagcacacagaaagtgaccaataaatatttctggaattaatgtagtaatgaatccaatctattttacttagtgacttgtagaaattcttttggtttccattgactatttttatagaatattaatatggaattaaagtatttttcaaaa

SEQ ID NO: 3619 - DNA, 2588 bp, Homo sapiens
  ENST00000579658
atactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattag

SEQ ID NO: 3620 - DNA, 1963 bp, Homo sapiens
  ENST00000540086
aatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcagggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattca

SEQ ID NO: 3621 - DNA, 1677 bp, Homo sapiens
  ENST00000454642
ggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatgatatagggatgctgtattccttgaagattacatttcaaagagatggtcaccattacttgataaatacaatcctggatcctaaagcttccaagaaacttgttgaacttttgaaagatttccatacgcttcaaagggacaaagaaaaaacttacatacaaagctttttttttccctctctctctctctttctctgtgtgtgtgtgtgtgtgtgtgtgtgtgtgtatgaatgctctgagaaaaggaaggaaagaaaaaatattttcccttgctttcaacaagtacaaggcctctaatttttaatttgttttgttctttcaaattatcattgcaaatagtacatatattttaaataaaaacactaaaacaaactaaa

SEQ ID NO: 3622 - DNA, 587 bp, Homo sapiens
  ENST00000580157
aatggggcacatcgagagtttgctgagaagactgtgaagcaaaaagaagaaagtttttcctactcttccttatgtgtccaacacgaagtttgctgttcagttttcacagaacttctagaagttgaagttacaaaggacttccacagctatattaaataggagtggtgagagtcagcatccttgtcttgttccagttctcaagggaaatgtttccagcgcttgcccattcagtatcatgtttgctgtgaatttgtcatagatggctcttattatatttcaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccag

SEQ ID NO: 3623 - DNA, 4332 bp, Homo sapiens
  ENST00000269141
cctccaccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccccctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgtgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgtttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctgg

SEQ ID NO: 3624 - DNA, 3737 bp, Homo sapiens
  ENST00000399380
aagcagaaggaattatgggaaatggaaacttgatggcatgtttttattaaggcgttatgtgtgtatcttcactgagaaattaaagaaccaagcagaattgtatgttttcctttcagtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccccctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgtgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgtttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaa

SEQ ID NO: 3625 - DNA, 740 bp, Homo sapiens
  ENST00000418492
agtaagagtgttccactcagataggctagcatgagcaaggcagaagcctgaaacagttggatgtgttccagaaactgtaagcaattgaatacaatggaaatgaagttcatttacaagaccatgatgagagaattgacttttaggctgtggccacattgttgaaggacatgtgtaacactcaaaggatgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatatt

SEQ ID NO: 3626 - DNA, 610 bp, Homo sapiens
  ENST00000430882
aagaaacacaaatacacattgattccttgtagacacagatgcagaagtgaagaaaggatactactttcttttatcctgcacatcagagcgggtacaccgtcagctacaagggagaccctgataatgcctcagggggactctaagcagagtgtactggaaatacagagtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcct

SEQ ID NO: 3627 - DNA, 563 bp, Homo sapiens
  ENST00000413878
agattgctgcagggaatctgtgagctcccagcatggaaaatgagatcaccaagcttcttttctgtggacctgtgactcccagatgggcggagtaggggacagggttgggcaccagctgctcagattattctttcaaatgcaggcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaag

SEQ ID NO: 3628 - DNA, 11139 bp, Homo sapiens
  ENST00000224721
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgaggtaggagccactgggaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgaaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctcaa

SEQ ID NO: 3629 - DNA, 2000 bp, Homo sapiens
  ENST00000461841
ggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactctt

SEQ ID NO: 3630 - DNA, 3954 bp, Homo sapiens
  ENST00000299366
gcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtgctgccccggcctccgcccacctgtgcaggcctcctggggccctgcctccacccctcccagatggacagccagactaggtgggggcaggtgagggtggaaaagaggtcagggctctactgttgggctttagcctctggtggtgcctcccgaggatttgctcctggctcttcccaagggctttgcagctggatcactctggactggctccctggggacctcctgaacctgttggttgcagggacggggagcatctaccaaggttcattctagagggaggtaaggccccatgattcctagggaggagccctgagccccactccccgccccaagtctgggtgacagagcagtgacttggaggaatgtggcctcatccttccttggggacctgttgagaattcccacctgtttagaggcagatggttttgatctccctaaatgaaatggttttagctcaaaaa

SEQ ID NO: 3631 - DNA, 4814 bp, Homo sapiens
  ENST00000616684
cgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacggtgaggggctgggggcagggagcaccatttcttccaatctaaccaacattggttgagctccttctgtgtgcacagcactctcctctttgtcataaaatgtccttgagatggccaagtgtggtgttaggtacctgtagtcccagctgcttgagaggctggggcaggaagattgcttcagctcaggagtttggaggctgcagtgagctgcgtttgcaccactgcactccagcccgggcaacagagtgagaccttgtctcttacaaagaaacaaaaaaaagtccccgagatcaatatccctgtaacacatccattttcatatgtaggagtaagataaagtttatacctatg

SEQ ID NO: 3632 - DNA, 4475 bp, Homo sapiens
  ENST00000466757
agacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgaggagaacggaggctggcttcagggccgaccggagggagtgggggaaggtctgcacgtgcagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcaggcagcacccgccctggcctctgaagggagcctcctcgatcatcttcaatcccttcctgattgatcccaacgtgggtgccctgaagaggggccaccaagacggctgccaagaccatgcttggagagccctgtttgctcctcctcccagctggcacccaggcatctgttccaccaggagggaggcagctgctcccacagggcaccaggcagatgctggcagcacccgggaaacccaaggaagagagccccgaggttttgccccagcactgggccagcacagatgccaggacagtgtcttggccccggtgtaggctgagcatttcacttgactaaagggaacctttgccatttggcaacttctccatgctgggctttggcacctggagggcaaggcttctgtggcgagcgagggtgctgcttctaggaggtggttacgagccccaggttgtaccctgtggagcctcaggccaaaggcccagatgaccacgagtgcacatctcttgaccagaagtctttcatcaagcagcagcgagggggtctgcagagaggaaggtgctcttctgaggatcatctttgggaaagggcgctggcctgggcatgcaaggagcttcggggggtgagtgtgtgtcccagactgcttgggccactgtcttcctgcagcctgcagcaccggtctctgaagcaggaggatctacaggtagacctagggggatgtgggggcatgtttgtggacaccccattacatcttggtagattccatgtagtcacagtggctgcggttgtcctcggggcccggcaggggctgtcgagggacggtgggccggccatggcggaagctgtgcagggagaggcgcaaggagcccaggcgcttccagagccggagctggggctcactggggctcccagggtggtggggcatgcactcgtgagccctgcggcggctcgggtccagcgcggccggcttgcagagcgtcatgaacagcagacaggtggccagcaggaggaagatgcaggccagggcgatgagcatggggagggggtcagttgcctctgcaagggtcccgggagtgacgggagctgagagaaaggcgagggggctgatggctggggagctggcgaggctggggccctctgtgctcatggctcctgcaacagcaacaagacagaagctcaaaggcagatcagctggacccagggcagcgggtatagggaagacttacctagggaatgtggatgggggcaaggcactgttaaactggacagcatcatggccacatcacaggttaagacagcaaggtccagagacatcacaagtctaagtgtacacacagctgagcagtgatggagctgggcccaagctcaggccctcttcctgttccaccctgtgcccatctgccatgcagacaagagggcggtggcctgtccgcattttcaaatcaatcctcatgaatcatcacagggtcttaggcctggaaacttaagaccaactctgtcaataacttgctctgtggccaggaacgagttatggatggtaagaggccgcagctgccagggtccctagcagtaatctaataccaaagctgcaaactgggggcccacgggtgtgtttagttgggtccttgccatgtttttatcaatgtaattatgaatattttcaaaataataacagatttcac

SEQ ID NO: 3633 - DNA, 704 bp, Homo sapiens
  ENST00000470494
tgacaatgccccggagttcaacagctccgagtacagcgtggccatcactgagctggcacaggtcggctttgcccttccactcttcatccaggtggtggacaaggatgagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctgtgggaaaagttcttttgcagtaattccagcagattctcatcggcccagttggttgtgtcatcctggaaccaattgtgattctggtatgccggggagggatcacactccccctagtggacccaggggttggggtcagccccgcctgaattacaccgtctgagaatggggaaggggcttctattctaagacaagggattgaatgctaagcagatccaagtggtagatgtgtgctacacaagctcagagtcttgcccagtcggtgctcaataaatgtcacggagtttaa

SEQ ID NO: 3634 - DNA, 7000 bp, Homo sapiens
  ENST00000442677
cggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcaggaagacttggcctccccctgcatatctcccgccccacccagaagggcctttcagagtagcggggagaaagagacgtcacaatttcccggaaaggagttgagaagagagccagggcccagcaaggcccagaacagagctgctttcacagagcccttggccgaggctcccctcttgggaagtaaacaggcacaagaagaaagggctcctttgcccagggagcaggcgcaacagctccaaggctcagagggagagaagggaggaccctgaaaacaatttgggtgtgcacccacacctctgcccagaggcctcagttgctgggtggggagggaggcccggagtgaatgagtctctttaccaactatggggtttccgactcggaggctgagccaaacagggaatctgggcctgcccactggggcaggctcccgggcttgggagggacagaagcgtgggaggctggcaatgctcccctccctgcatcgggaccaggaggcgggcaggaaagggctggggagcagggagctgactcccagaaacacagagagcccagaaagccctgaggatttgcgagagtgtggtggctagctccagaaggaggaagtagagggttctctcgatcagggcctcagcttgtgaggacttggagcatacccccctggcctggtgcctgaaacccaattgagagccctccccctcctggacttttccttcttcaggcctcagggcagcctcaacccccaccccaacctccaggaagacagtgcctagtggccagcagggcctgctggtgaggtggatggctacaggctgaatccagcctaggatttgcagggaggccccaggggaagcaaaccaggaagaggttactgagcaggaagggaggaaggaacaaaacccttagggaggaggcctgccccactttctaaacccaaagacttggtttctatttacacaatactactcttactgaaatcctagagccagcgagttaatatagggcagccctgagttctcccatttctcagggagaaatgcagcgtctcaggatgacttctccaaggtcctcttggtaagtttcttgtgaagccggactcactttttgagatcagattgacttggaaggaagggacagtgggcttctccaatagagcctgcttggagagaaatctttctagagtcatctgagggaagatgaggctctgtgttatgccagcttccaccaagactcctgcctcagagggtggggacacacccaggctgggccacgcttcactctgtacacagaagcctcatacttctgtgcacagaactggggagtcaaagtgaggggctggacaatgtctggctctctgcaagctcccaagctggtaggaaagagaagacatagacaaaaaggacccatgctgccaagagaatgttccttttcctccccaagagaggtaggagacagtaggggcggctccaggcaggagggcttcacagagtgggtgtgtgtgaagcataagccacagttagtgggtgacaggtctttcagttttcctggagttttggatcaagatgaggctagaaagattaattggagccagctcccagagggcactgcacactgcgctgaggagctttggctatatccatttggcattagggagccagtgaaggttttggagctggggagtggcaagccagagctcactccttggggagacgtggctggctgcactgtgggtcacagcaggatgggggtggggcagctttgtggtgggatcctggccagctgactgggacaggagctgggcagcccaggtcctccctctgcccacccttcaaatttgggacctgaccaaagtgtttaaccctcgcgttgtgaggagaggtcaagggtttgggattctgagaagcccatcctggggtgggactgctttgacgggtcatcagcaaagcactcaccaaaaccacagatagcatccctagtgtgggcaggacttgggaccccacagctgtcctggagaggtccagaccatcccaccctcggggaggctgccgctttccctgggtgaggtgtggagctgctgtgagctgtcctcctccgagtccaggtggcatcacctccagctgctggaaatgccctgcctcttgccactctgtcacagcacccgccctggcctctgaagggagcctcctcgatcatcttcaatcccttcctgattgatcccaacgtgggtgccctgaagaggggccaccaagacggctgccaagaccatgcttggagagccctgtttgctcctcctcccagctggcacccaggcatctgttccaccaggagggaggcagctgctcccacagggcaccaggcagatgctggcagcacccgggaaacccaaggaagagagccccgaggttttgccccagcactgggccagcacagatgccaggacagtgtcttggccccggtgtaggctgagcatttcacttgactaaagggaacctttgccatttggcaacttctccatgctgggctttggcacctggagggcaaggcttctgtggcgagcgagggtgctgcttctaggaggtggttacgagccccaggttgtaccctgtggagcctcaggccaaaggcccagatgaccacgagtgcacatctcttgaccagaagtctttcatcaagcagcagcgagggggtctgcagagaggaaggtgctcttctgaggatcatctttgggaaagggcgctggcctgggcatgcaaggagcttcggggggtgagtgtgtgtcccagactgcttgggccactgtcttcctgcagcctgcagcaccggtctctgaagcaggaggatctacaggtagacctagggggatgtgggggcatgtttgtggacaccccattacatcttggtagattccatgtagtcacagtggctgcggttgtcctcggggcccggcaggggctgtcgagggacggtgggccggccatggcggaagctgtgcagggagaggcgcaaggagcccaggcgcttccagagccggagctggggctcactggggctcccagggtggtggggcatgcactcgtgagccctgcggcggctcgggtccagcgcggccggcttgcagagcgtcatgaacagcagacaggtggccagcaggaggaagatgcaggccagggcgatgagcatggggagggggtcagttgcctctgcaagggtcccgggagtgacgggagctgagagaaaggcgagggggctgatggctggggagctggcgaggctggggccctctgtgctcatggctcctgcaacagcaacaagacagaagctcaaaggcagatcagctggacccagggcagcgggtatagggaagacttacctagggaatgtggatgggggcaaggcactgttaaactggacagcatcatggccacatcacaggttaagacagcaaggtccagagacatcacaagtctaagtgtacacacagctgagcagtgatggagctgggcccaagctcaggccctcttcctgttccaccctgtgcccatctgccatgcagacaagagggcggtggcctgtccgcattttcaaatcaatcctcatgaatcatcacagggtcttaggcctggaaacttaagaccaactctgtcaataacttgctctgtggccaggaacgagttatggatggtaagaggccgcagctgccagggtccctagcagtaatctaataccaaagctgcaaactgggggcccacgggtgtgtttagttgggtccttgccatgtttttatcaatgtaattatgaatattttcaaaataataacagatttcacaaaaatatatgggtgcctgaattctcttgaaatgtcagaatttcaccactggcattggcccatgttcctgcctcatccctgtgtctggggctgagcagccgctgccccctgtagacagggcactgacctccagctccccaccctcccccacaggcccaccacacaccttatttcacctgcctggccccgtggggattcctgtgactgcttccccatgcagtccaacttgctcccacgacaggtgggaaactgaggtccgaagaggggatttggcattagggagccagtgaaggttttagaggtggggagtgacaagccagagctcactccttgggaaggcttggctggctgcattgtgggtcacagtagggtggggtggggcagcttggtggtgggaaggccaaggccacattgtgagccaatggccaagtgaaggtcagaagcaggtctcctgactcctggccccatggccttgccacccctctggcccccagccctttcggagctcagtgagctgctctgggaacaggtgggaaataaacccacaaggagttgacaagggggctggaaaccccccagggacatcatacacctgacagggcatttcctttcccactgaagatcatcccattagacgcagtgcagcagacggtccttgtcgatggaaaaccaggctgagcttttggctcaatatgtctggggttgtaataaaaatgctcacagatcctggccagcagataacacatgaccagagggtacagatgagcagggccacctggagagcactggctgggccctctcaaggaagtggaggggcctcagcccagaatggtgctgtcagtgccggagtgcaggcccagtgtggtcagctctgtcagtttcccaagagaagccagaaatctggatttttttaaaggcaaacattctagacgtttaaatgttggcagctaattcaaatttgttgaaggcaagaaagaagagaggtggggtgggggagaacacagcaaaagccaaataaacttgatttcaaaataa

SEQ ID NO: 3635 - DNA, 1649 bp, Homo sapiens
  ENST00000398792
acaggaagtgtgcccctctctcaggcagctgctaacacctgtcttccttcaactcccacagacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggtgagcgatgggggtggccacagggaggagcgggtgggccagggcagctccgcctccgagtgaggggaacaagatgggtgagaatggaattccacacagcaggcgaatccttgac

SEQ ID NO: 3636 - DNA, 4114 bp, Homo sapiens
  ENST00000475158
cacagaggtgcagagaggtgacataacttccccaacatcacctgcttagtaagcatcatgggaggggcagagccacgtgacccaagcttatgaggaggctgtgggcccaccccagccacaagtcccagattctactggggaccgtcatcctttgtggggattgggagggtttggccaggagcacccctgggaagggcagattttagggggttcttctcaggctgaacctggcctggtctggtccacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttg

SEQ ID NO: 3637 - DNA, 4224 bp, Homo sapiens
  ENST00000619887
ccctgctgcaccctgaactaactgatgttaaccctcttctctcttcctcatggctggcaggcccacaggtttgagctctgtttctctgtcacttcccacctcatctcttctctgcctcaccccattgccttcctccatgcccaccacacccccaccacccttcctgtcctgtggggcctgggccaaggccgtggcccagcctttgcagactgaatgcagccgccctctccccatcctcgctccccagcctgggggacagggagcgagagtaggaagaggaggaggaggaggaggaggaggcggcccagggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctc

SEQ ID NO: 3638 - DNA, 4329 bp, Homo sapiens
  ENST00000398788
ccctgctgcaccctgaactaactgatgttaaccctcttctctcttcctcatggctggcaggcccacaggtttgagctctgtttctctgtcacttcccacctcatctcttctctgcctcaccccattgccttcctccatgcccaccacacccccaccacccttcctgtcctgtggggcctgggccaaggccgtggcccagcctttgcagactgaatgcagccgccctctccccatcctcgctccccagcctgggggacagggagcgagagtaggaagaggaggaggaggaggaggaggaggcggcccagggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctc

SEQ ID NO: 3639 - DNA, 11122 bp, Homo sapiens
  ENST00000622827
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagacccagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgcaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctc

SEQ ID NO: 3640 - DNA, 1759 bp, Homo sapiens
  ENST00000398842
cgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccttggccatcatcatcaccaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactctt

SEQ ID NO: 3641 - DNA, 4533 bp, Homo sapiens
  ENST00000398809
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcaggcagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacggtgaggggctgggggcagggagcaccatttcttccaatctaa

SEQ ID NO: 3642 - DNA, 3182 bp, Homo sapiens
  ENST00000348616
agtcttttgtgtacgtgcaggaccatggtggctttagtttctaccccacccttcctaggaactctacttgtggcaaacgtatgttcaagcttacaagtcagcccaccccactctgataaatgcaagaaaagctgaaaagggaggagcaagatgggatgaaagcatctgggccaaagtgacctgaaaacctttagagaagaagctgctggctgagaaggaggtgtgtggctccggtgagaccaccagcttggaggactggtcatcagctgcacgttctgggtctgtcttgggtattcccatatggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgtta

SEQ ID NO: 3643 - DNA, 597 bp, Homo sapiens
  ENST00000477058
atccctggcctccgcccagtagatgtcagtagcacccctcagctgtgacaaccaaaagtgtcaccagacattgccaaatgtccctcagggagaagaatcacccttgggtgagaagtctgcacctgaggttttcacaccgtgttcaggattctagagggaagtataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagaca

SEQ ID NO: 3644 - DNA, 1669 bp, Homo sapiens
  ENST00000370991
ccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagtctaaagagagaaatcgcttcagcctcagcaggggctgcatcatcccccagggaagagccacagctgggcgaggattgccacaagacatttacaaggagatgatgccacggagactaacgcagactggtaaacggaaacacggggctttggctcgaacaccctctttcaagaaagttgtttatgaccacaaggaagatgaggagaacaaggctgggagaaagcaaaggagccacttgtttaaggttatgcagctgagaaatgaacaaggtggggttcgagtccagagtgcgcattccccatcaccccttaacaaaaaggcatgtttcccaggagactacagaggagaatcggcaggtggtcacaattgcagggctgtctcaggctgagcagagagtacggtggaggggcatgggcctgctgttggcggtgagggccttggaaatggcttcctggaggagatggcaattatccaggtagacaagatgtgtgtgtgtgtgtgtgtgtgtgtgtgtgtgatcatgaagaagaaataatgtgcaaagccctggtcataaataacttttcctctgcaaactgtggatggcagttcaccatgtttctcaccactggcctggtcactgcttatccaatatgcatgtaagaattactttttctcttttttcccttctataaattctcatagaacttcctttaatgcattaaaaaagcaactagcatgttc

SEQ ID NO: 3645 - DNA, 1429 bp, Homo sapiens
  ENST00000497614
tgcacgagataaacaactcctgaaacttcctccccatacaaggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaagggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgtta

SEQ ID NO: 3646 - DNA, 1931 bp, Homo sapiens
  ENST00000244049
tggcaaggctaataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagtaaaagagttaggagcctttgaatgagtaagttctgattagattttatctttaaacaaaaccacaaaatttaattggtttttacttgtccacttactgctagtgtcagtttcaggggaagaaatggtttcttttaaaaatcttaataggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatgtttgctggtgaatcagtgaagcattatgttaaacagtgagttacagctcagagttaaaactttctccttctttttgaagaagctgtgcaaatacttctttttaaggagatctggccttttcctacctggttacctcagtcttcctctgctttgggaagctgaaaaagaagaaaaatcacatttaaagcactggaatgtctgaatgggacgcttgaatgtgtagaacagctgtactgatcctagcatgactcagaggacagtctagggcattttctgggtaattcaggataaaagtatttttttttttaagaaaaatacatgtttttggacaacaaaacaaagtaaacattagtttattcgat

SEQ ID NO: 3647 - DNA, 2494 bp, Homo sapiens
  ENST00000350849
aataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagtaaaagagttaggagcctttgaatgagtaagttctgattagattttatctttaaacaaaaccacaaaatttaattggtttttacttgtccacttactgctagtgtcagtttcaggggaagaaatggtttcttttaaaaatcttaataggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatgtttgctggtgaatcagtgaagcattatgttaaacagtgagttacagctcagagttaaaactttctccttctttttgaagaagctgtgcaaatacttctttttaaggagatctggccttttcctacctggttacctcagtcttcctctgctttgggaagctgaaaaagaagaaaaatcacatttaaagcactggaatgtctgaatgggacgcttgaatgtgtagaacagctgtactgatcctagcatgactcagaggacagtctagggcattttctgggtaattcaggataaaagtatttttttttttaagaaaaatacatgtttttggacaacaaaacaaagtaaacattagtttattcgattgcctccttatacttgcctctttcattctgtcccctgtagatttttaaaaaattatctcattttaaaactttattatttcattttaaataattgacatataataattgtacatatttagggggtacatagtcatgtttcaatacatttacagtgatcagatcagggtggttaacgtaatcattggctcaaacatttttcatttctttgtattggtacggagcattcaatatccatcccccttctagctatctaaaactatgtattattgttaactataggcaacatataatggtatagagtgctagaacgtattcctcctaggaataatttgctgtaattttgtatcctttaataaatctctccctatccctctttccccccacccttcccagctgctgtgtcctctgttctaccttctacttccgagataaacttggttttagcttcca

SEQ ID NO: 3648 - DNA, 418 bp, Homo sapiens
  ENST00000456106
aagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaagggttatggcaagccctttgagccaagaagtgtgaaaaacatacactctactcctgcttacccagatgccacaatgcacagacaactcctggctccggtggaaggaaggatggcagagacattgaatcagaaactccatgttgcca

SEQ ID NO: 3649 - DNA, 1976 bp, Homo sapiens
  ENST00000629889
aaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaggcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggtgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgttttt

SEQ ID NO: 3650 - DNA, 2008 bp, Homo sapiens
  ENST00000628489
aaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaggcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggtgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaaagaagaaagaaag

SEQ ID NO: 3651 - DNA, 5377 bp, Homo sapiens
  ENST00000625686
aaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaggcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggtgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaaagaagaaagaaagaaaaaaaaaaaaaaaagaaagtgccttttggtacatgtatcagattccctcaaactcaggagtgtctaaagcagacagaccgtccccaccttcccatcccgagcggcctccaaccccagctagtcccagctctgaaggcatcattcagaaatgggggagactgtgtctgtctttcttactttttttttggtcttttattaagaaaaagaaagtgggtgacttgtttgaaaacagagtggggttcaaatcccagcagcctttgctgtacacagctgggggtctcttgagcctcttgggagtcaaggccagctgggaggcttagcccttcagccccagcagaaggccctggggctggtggggctcagaatacccctaccttgtggctgctccccaccccctcccggatgctgtgaggagctcaggcaggggcctggaggggaacaggggtcatcctgaaggggctccacccccagtcaacccaggcctccctcagggacacctgtcaccctgagtgccaccaggtcccctctgcctttggtccagaagagtgagttgtccaaaccagccagcatctggctccagccctccaaccctggcgaccagaccccatggggtgccatcaacggccccgcgacaggcatcaattcaaaccccaggacactctcgacagctccaaccatccggagggctgtgcagatggcaggaaccaaggaccctccctggcagctgaagagggcagttacggttgggcgtggtgaccagaacacacccagcagcctgcgaagcctccccgtccccagcctgtgctcctgattcccgccagacgcttgtgagcctgtgtgggtggcaggaggccccgtcttgccgtgcctacctgtcgcacaggtgcctctgcacgctgcagacggtgcctctcctctcctatggaccctcgtcgggggcaggcagcggccgggtccaaacttgctgctgtcctcgaggctggcactgctatctccagggctgggttgactcaagccagacagggggaaggaattggttctgcaggacagtgagagggtctgtgtcccggcacccctgggacagcgctcggctgcctgtgctcactgcatgagaaaactcagagggtgcattctccctctggcatggctgtgtctgggcgccttgggctgcggcagggggcaggccccacgtggggaagcctcgtgcttggtcagctttctgtctctcccaggccagtgacaactggcttcccgaggaaggaggtgaggtaccagggaccctgggcaggacctggtgtcgggcagggcggtgccagcactggggaaggacagggagccctcccggagccccaccctgcacctgccactggggtcagggagtgtctcggggtgcctttgggggcagcatgagctccaccaggggccccggcccccacctcagcctatggcccttccccatggctaaggtcatgccttttctgaacagctttggccttgagtgcacacatctgtgccaggctcacggcatgttcccgttggatgtcagggtccttgtccaaaccaaactcacagctgcccctgtgcagccttcagagttgagctggggtctcagtctccaacctgtcctttctgaccctcccatggctgcccagggagggcggggttcactgtgccacgtgctgggtgcccccctctgcagacagccagtccaggagatggaccaacagaggtcaaggggcagctggccaggccgcaccggggtccccgagttctgagctgtgctatgcaaacaagaatgctcctgtgtgggggggcatggccgttggaggtatagctgggcgggtagtggaaggactggaaatctctgttgttgtttggggaagtccatgcttcagtccttcggagtatgcgtggattgttcgaagtgtgactatggcccgggagccagggcagcatgaactcctttctctgaaatttcgaggcctccttgggttccctgaactccgggctgatgttcccaggacccagcaccaggagaccccagtcccgccagcagccgccgctacccaggagggctgggcgacattggccgcctcccactagctccccctcctcgcccacagcctcttgtcactgccaagcccccgttccttttgcccaaatcacgcaggcggaagctgcagtgccagctggagggatgttcatagggcttcctgtgcccatccctgctccaaacagctggacagcttcccctctacccccaccctggtgagcccctgggggccagagaaagatggggttcctgcaccttcccagctccacctctgaacttgagttagcgttagctaagcatacaatcagtgtcgaacgtctctcttccttaagcttgtagatacgactgcctataatcaggggactcccactggaggccgggaggccaatgctggccaggtgcgagggcatggtttggttcctttagggaatttttgttttgcaaacaggagaaacctgtgctgcaggttggagtggcaggaacgactggccttggtcagcaggcagcccccagcctagggccacagtcctcttcagggcctgggcagccccaatttctggcccagcaggtttctctttgtagtgtctttcagcacatccaaaatgctaggcctcctgccaccaacgtgtcagagcaatgtccaactgtcaggctctcagagatgcctcagtttccctagcatgagcaccagccgacacacacagtccactgagatgataattctgttctctccaaagcaaaaagctgggcgaggggtagtctcaatttctgtcagtgctcaaaggaataacaccaaaagaatcaacacagaatctcccagacacacgtgacccagctcgtggcgccgtgggtccgtaggagggacagtacctcacaacaggcccagcgggggaccacctctctgtacaattggaatgcgttttacttttcttttctctccttttttcattccgattttttttgcatgtttctttttgaaatgggcaaaatgtgtagcagcctgcatgagcacagttgttttggggaaagatactggagtatgatgtactcacacctgcaaatctgagcatcgcgaggttaaacgttccacctttttttgtaatcgtcaacagcacaactattttgtattgttgtttgtatcattttgtaccaaaaaaaaaaaggaaaaaaaaagggaagagagttgatgttttcagtgtgtttccagtgccagacagtcttggtcctgaactcagtagacccttgcggagcggttgtgcgcgggcaggcggggcgcgctgctccagagaatgaataaagtcccccttttccgta

SEQ ID NO: 3652 - DNA, 6513 bp, Homo sapiens
  ENST00000614565
agcggcggcggtggtctcggcggcggcggcggcggcggcggcagggagcgggctcccggtgccgggcaccgggcgggcggcggggaagatgaccgcgggcgccggcgtgctccttctgctgctctcgctctccggcgcgctccgggcccataatgaggatcttacaactagagagacctgcaaggctgggttctctgaagatgattacacggcattaatctcccaaaatattctagaaggggaaaagctacttcaagtcaagttcagcagctgtgtggggaccaaggggacacaatatgagaccaacagcatggacttcaaagttggggcagatgggacagtcttcgccacccgggagctgcaggtcccctccgagcaggtggcgttcacggtgactgcatgggacagccagacagcagagaaatgggacgccgtggtgcggttgctggtggcccagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaagaagaaagaaagaaaaaaaaaaaaaaaagaaagtgccttttggtacatgtatcagattccctcaaactcaggagtgtctaaagcagacagaccgtccccaccttcccatcccgagcggcctccaaccccagctagtcccagctctgaaggcatcattcagaaatgggggagactgtgtctgtctttcttactttttttttggtcttttattaagaaaaagaaagtgggtgacttgtttgaaaacagagtggggttcaaatcccagcagcctttgctgtacacagctgggggtctcttgagcctcttgggagtcaaggccagctgggaggcttagcccttcagccccagcagaaggccctggggctggtggggctcagaatacccctaccttgtggctgctccccacccctcccggatgctgtgaggagctcaggcaggggcctggaggggaacaggggtcatcctgaaggggctccacccccagtcaacccaggcctccctcagggacacctgtcaccctgagtgccaccaggtcccctctgcctttggtccagaagagtgagttgtccaaaccagccagcatctggctccagccctccaaccctggcgaccagaccccatggggtgccatcaacggccccgcgacaggcatcaattcaaaccccaggacactctcgacagctccaaccatccggagggctgtgcagatggcaggaaccaaggaccctccctggcagctgaagagggcagttacggttgggcgtggtgaccagaacacacccagcagcctgcgaagcctccccgtccccagcctgtgctcctgattcccgccagacgcttgtgagcctgtgtgggtggcaggaggccccgtcttgccgtgcctacctgtcgcacagatgcctctgcacgctgcagacggtgcctctcctctcctatggaccctcgtcgggggcaggcagcggccgggtccaaacttgctgctgtcctcgaggctggcactgctatctccagggctgggttgactcaagccagacagggggaaggaattggttctgcaggacagtgagagggtctgtgtcccggcacccctgggacagcgctcggctgcctgtgctcactgcatgagaaaactcagagggtgcattctccctctggcatggctgtgtctgggcgccttgggctgcggcagggggcaggccccacgtggggaagcctcgtgcttggtcagctttctgtctctcccaggccagtgacaactggcttcccgaggaaggaggtgaggtaccagggaccctgggcaggacctggtgtcgggcagggcggtgccagcactggggaaggacagggagccctcccggagccccaccctgcacctgccactggggtcagggagtgtctcggggtgcctttgggggcagcatgagctccaccaggggccccggcccccacctcagcctatggcccttccccatggctaaggtcatgccttttctgaacagctttggccttgagtgcacacatctgtgccaggctcacggcatgttcccgttggatgtcagggtccttgtccaaaccaaactcacagctgcccctgtgcagccttcagagttgagctggggtctcagtctccaacctgtcctttctgaccctcccatggctgcccagggagggcggggttcactgtgccacgtgctgggtgcccccctctgcagacagccagtccaggagatggaccaacagaggtcaaggggcagctggccaggccgcaccggggtccccgagttctgagctgtgctatgcaaacaagaatgctcctgtgtgggggggcatggccgttggaggtatagctgggcgggtagtggaaggactggaaatctctgttgttgtttggggaagtccatgcttcagtccttcggagtatgcgtggattgttcgaagtgtgactatggcccgggagccagggcagcatgaactcctttctctgaaatttcgaggcctccttgggttccctgaactccgggctgatgttcccaggacccagcaccaggagaccccagtcccgccagcagccgccgctacccaggagggctgggcgacattggccgcctcccactagctccccctcctcgcccacagcctcttgtcactgccaagcccccgttccttttgcccaaatcacgcaggcggaagctgcagtgccagctggagggatgttcatagggcttcctgtgcccatccctgctccaaacagctggacagcttcccctctacccccaccctggtgagcccctgggggccagagaaagatggggttcctgcaccttcccagctccacctctgaacttgagttagcgttagctaagcatacaatcagtgtcgaacgtctctcttccttaagcttgtagatacgactgcctataatcaggggactcccactggaggccgggaggccaatgctggccaggtgcgagggcatggtttggttcctttagggaatttttgttttgcaaacaggagaaacctgtgctgcaggttggagtggcaggaacgactggccttggtcagcaggcagcccccagcctagggccacagtcctcttcagggcctgggcagccccaatttctggcccagcaggtttctctttgtagtgtctttcagcacatccaaaatgctaggcctcctgccaccaacgtgtcagagcaatgtccaactgtcaggctctcagagatgcctcagtttccctagcatgagcaccagccgacacacacagtccactgagatgataattctgttctctccaaagcaaaaagctgggcgaggggtagtctcaatttctgtcagtgctcaaaggaataacaccaaaagaatcaacacagaatctcccagacacacgtgacccagctcgtggcgccgtgggtccgtaggagggacagtacctcacaacaggcccagcgggggaccacctctctgtacaattggaatgcgttttacttttcttttctctccttttttcattccgattttttttgcatgtttctttttgaaatgggcaaaatgtgtagcagcctgcatgagcacagttgttttggggaaagatactggagtatgatgtactcacacctgcaaatctgagcatcgcgaggttaaacgttccacctttttttgtaatcgtcaacagcacaactattttgtattgttgtttgtatcattttgtaccaaaaaaaaaaaggaaaaaaaaagggaagagagttgatgttttcagtgtgtttccagtgccagacagtcttggtcctgaactcagtagacccttgcggagcggttgtgcgcgggcaggcggggcgcgctgctccagagaatgaataaagtcccccttttccgta

SEQ ID NO: 3653 - DNA, 3304 bp, Homo sapiens
  ENST00000611855
atcttgggcctgtcacttggggagcactgtagaaggttctggagaaggcattgagactataattctactttaatgagctgggctacctagattctatggtacagcaagagaagctgtttgtatgcacctgtatgtacgtgccttacttaaaattcagaaagaaaatcttcaggtgccagaattacttgtgaggctggtgaagagtgaaaagccacttcccaggccagacaggaaagagtgccctggttgggaccagacgggcctggctgcagacgtacactttgggcttcagcagccctggtgctgccttgagcttgacccgaattgcttcttcccagaggctgggtctccctcgcagcccctgctctcaaggatgggaatgagaaggtcgatgacaaggcacctctgctttacatccaagcgttgacttttgtggcttcctttaccccattgctctgccctttaaagggtcctggtgtgtttgggaatgggacagacaattttgtttttcacaatggtattgggctgtggatccagaactcaagttccagaggaaagcgatgccaaagtcaacagggatgcttcacggaggcagggaaaatgcaggagtcaagttcagcagctgtgtggggaccaaggggacacaatatgagaccaacagcatggacttcaaaccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgttttt

SEQ ID NO: 3654 - DNA, 3117 bp, Homo sapiens
  ENST00000543233
gcactggcgctctggctttcttctttctccctctgccttaatgatgctgcccctttcctgttcctggttgaagctgaagcccgcttcccttcgccgcacacaacacaggagcaatcttctcagccgtgcactcacagcttggaaaataaagggaggaaggagtcccagccacagggtagaggaacggcctctccacagagaagctgctgctgctgagctgaagtgacagtcaagttcagcagctgtgtggggaccaaggggacacaatatgagaccaacagcatggacttcaaagttggggcagatgggacagtcttcgccacccgggagctgcaggtcccctccgagcaggtggcgttcacggtgactgcatgggacagccagacagcagagaaatgggacgccgtggtgcggttgctggtggcccagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaagaagaaagaaag

SEQ ID NO: 3655 - DNA, 2728 bp, Homo sapiens
  ENST00000323011
ctagggcagtccgaggagattgaaagggcaaaactatcaagcaagaaaactgtaagttctgattagttttatgactttgccttcatgcctcaggagctcaactgatcacggctttcacgacaggctaaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattggtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactgaagaaaaagtaacagca

SEQ ID NO: 3656 - DNA, 3766 bp, Homo sapiens
  ENST00000536984
ctgggaggcgccgaagtctcagtggctccctgggccggcctccgacagcgctgacagcaggcgcccgccgcccaccatcgtcgccctcttcccctccctcttcggccccggctccggcgcgctctctcctcctctcctgcgcgccctctcgccctctctctggccgcgcgctcccgctggctccggaccctgcgtctcagctgcccgggcgagccggaggggcccctcgcagtgagcagacgcagcgggcccccggcgcccgaggccggggcagggtccccgcgcaccgcggagtgggctgtgattggaggaggagcccgtgccgggcgggcccgagcgggtgtcgagccggttcctccagtctgccccgcgcgcggagctgcgcgcactgggtccccaagagcccgcgggcgtccggcagccgagcgcacgttctttcggatgcacacgcccgggtccctggcgtctgacgccgtggggagggcagcgaggccccaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattgggtaggtactgtttccagggcttgctctgaaagagctgtcacaataaccacatgtcacgacttgcctattatcttctccatttggtgaacatatgcagatattctactggatggtgtttgttttgttttgtttttctttgagacggggtctcactctgttgcccaggctggagtgcagtagaatgatctgggctcactgcagcctctgcctcccaggttcaagcaattctcccacctcagcctcccgagtagctgggattacaggggtgcaccaccacacccagctaacttttgtatctttagtagagactgagtttcaccatgttgggcaggctggtcttgaactcctgacctcaggtgatccacccaccttggcctcccaaagtgctgggattacaggagtgagccacagctcctggcctggatggtgttttgctcactaagtaatacaattgttggccacactttccagtggtatatttgaagtataactcagacaaaaagttgtatcaatttcattttcaaagcaacagtgaagataaatggcttatgctttaaattaatgctttttaggattaaaaataatctatcttatcccagttctttgctttagagcactctacagaggagatacactagactggagaatacattttctatattgttttgacaatatgcttattttagaaattatggctttatattctactttttaaagaaattatttgattgctttcttaaattatttgcaaatttgaaatgattacaatttcagcaatgcaaatcttatatttttaaagtattaaatactaacacatttaattgtacatttccatgattagtttattactcggttaaattaaatttataactcatatttgcagtaactcagattttgcagcatccttttaaaaattgggagatgtccaatgtggacactgggtaatgggtttattccaaagaaacatttttcttcacattgtaacttgtaacacgaacacaacaagaacagagtaaacattcaatataccgttccatatggtgaatgttcaataaattttaagtgttactgatggaaaattataagctaagacctagttactaatacattataaatgctgtcgtgaaaatggaggttattgtcttaagtaacttaagctaaacaagtaaatctaaaagaaaataaactatattttgcatagaacttta

SEQ ID NO: 3657 - DNA, 12231 bp, Homo sapiens
  ENST00000397968
gggcagggtccccgcgcaccgcggagtgggctgtgattggaggaggagcccgtgccgggcgggcccgagcgggtgtcgagccggttcctccagtctgccccgcgcgcggagctgcgcgcactgggtccccaagagcccgcgggcgtccggcagccgagcgcacgttctttcggatgcacacgcccgggtccctggcgtctgacgccgtggggagggcagcgaggccccaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattggtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactgaagaaaaagtaacagcaaaaaataaaataaaatgaaataaaataataaaccactacatacagaaaacaagaactccccttgctggagacagatggttgtaaatatttctccatttttaattgtttagatttctgccttggtgaggcatatcttcattagacttatctaaaggactgcactgaccacagactctgagcatttgaaggttttttgataaaaataaatgctcagtggtttgtgaatagatagcaactctcatatacctgcaaaggcaccaaacctctatgagaaagtagtgccctgtgttgtcagtgagtcaaagatgccctgtacataccttcatggtactgtcattgagaggaatagaacatgatgagctattgaaaaaccctggaacttgttgcatatcaaaacttgggacaaatttaatttacagagatgcttatagcttactatattatagaatccaacagaattatgttgctcttgattaacagaaatattttatttaggaatatataaattcccagaaattccttcctaactgaaaaccctaccacaaaagccagtaaaatttagtttaaggcaatataaaccattgtttatccaataaattatgaagtgttccaaataagaaaaaggtaaataatttgatagttttgagatgcttgtgtaggtatgataaaaaaaaaagttgctgtctgttcattgatttttattatctcttctgatttgtacaggagaatatcttttcttttttatttgacacatggtgttgtatttattttggagctccaatctccactaaattcaggtccatcatactgcctcatagtattaaactcatcagaacatgctgatttttctccagcccgagctacatgaaggaaatgaagcatggaaatggagaactaatagtaaagcaattgagccctgttgcaggtcacatctcaaagaggagcacagctacaaggacatataaattgttcttctgagccattagaatgtcaaaacattggaataaaatatttgtattttagaaagacttcagagagaattgagattttctttgatgcaagaattatttttcaagatcatgagttctacatgctccaaagacgatttcaagaacacaacctttcttgctgcaaacctattgagtaaaatattgagtttttaaaagtcttaatataatgttataaaaattaaaatccatctttaaattctgatgcaaatatgtccctcaagaattaaccaagcaatgtatgatttctgtgtggtttagatgtgccaaaggaaggaaggcaattgcaagtcatcatgtgtttaagtttgagttgagcttgttagagtatgactttcatgaccaaaatgatgtttctacctattatttttcctagattaatactagtttaatgtgcatatacattcaagtaagaatggatttattttttccttcctttctccttttaaaaataattcattgttgggttcctaatacatttacagatagtaaacactgtgtagagaatcatgttctaaaagtgctttttgaaaggtagacagtggaattagaatattaatatgttgattacacaaagaagaactatgtaggattctgtaaacttgcagcccaactttagaaatgaagtatgtaaaagtggccttcaacttcataagtataaataatccaataaatttcattacctgcaaacagttctttaatttgaatagagttttgtagacattgttttatgactatatagatatgcttcttgctgtattaatatgcatatatattttaaaaaattataacagtgaaagatactgttcataacttttaatcacacatgcaagtttttcaaactaaaaaataacaaacaaacaaaaaaacacgcgtatttacccagttcaataaaatcagagtgtggtgcaggaattacagagttgttaagtcagcaaggtgctgagaaaacagtttgtaataatccccttgttgtctgcaagaagatgaaatagtttagtacatttggatgatgtcaaaactgctgattgttgcacataccactaaacggaggtgtggatgtattttagaaaaggaacacacatcattcaccctgctttttctgcttttaaaatgtgtgttttttctcattaattttttcaaatggttaccaatgatagattggaaaaagaaaggttcatgtttaaataataatttaaaattattgcatatacccaattgctatttatgtgtggatgattatatgaatacagtattacatttcattcagtggtattttttaattaaaaaaattaatttaaaaaattaatttttgagatggctggaagaatgttcctaatataggtagtatttatatgaagtattctaagcttaattgtaatagtagtaaattttttgccgttgcttattttagttttcttttttcttctgaaatctaatgctatatatgatgactgtcaatacttgagatataggctttgttttaaaaacagtgattgaagagctgattgataaaattaatattaagtctagttggaaaattctccaaatatgatttaaataaatatatattatcaagttgcttaaattcagtattatactgaaaccaactagaatgagctcacaggaactaattcttcatatctcttcccaactccaggtacagtgatatcattttggtaggttgatgtcagccttggtgggattatttagaccacaacagtaatcagcaaacactacccttttctctggagaacaagttgttaaacatttaccagcactctactgcttaaattattttataaaatgaaatgtcataattgtaaatatagtatgaatttatatgatttaaaataatgacatgaaaggaatttatgctatattttactactaaataacaatgtatgtggtagtgatttcctgaagtgaaatccttggagctacttgtagacagggagaggagtcacttctttatggaaaacaatggctaaatttcaagtagagataatagttcaggaagtcaatatatttaattattttccacttgtccatacaggagcatcaatagaaactcagggtttgccaaattatgcccattttgaacagtttaatttattgaaaaatcagatgcattttacttcttactgtctatgtcaaggaaatacacccaagcccttaatctgaattgtcaccattgcattattaaaaatcaacataaaaatataaaaatcaaatcttaaggaaatggatttctggagatcaagcctaaattatcaatctcaattcacaaattagtctctgaaagaaatattccaagatcagccagctaaggaacaaaatcaggaaagagacatcaataaaaaattaggtagtaatttgcaggcaataagtagatttttgatttttctacaagcaatcaccagatctgggatctggtaaatgtctttatttgccaggaagctctgctgatgactacaattgaggttagttgtctacaagatacatgcaggaggtagtagtggttaagtaatggtagctgccttttcactctgccctctgaggaagttttaaattattttatcttcatgcacaattacatttactacattggatggtagacataggcaattattttcatgtcaacggcatagttacacaatgtaggaatgatatttgtgaagtgatccacatgcccaagaaatgcaaatgcaaatagtgttgttagcatttatattgaaatataaaatctaaagcagcttaaaataagctaagctaaacaaactgcaagaagctaaatgatttaaacatgttaaagttttaaagcactagctgtaaatattaatcttcagattttcaatttaacatgtattcacttacaaactgttctaataataacactaattattttccaagtcaccatttaaagttttatttacagttgacctaatccaattgaagttgatgaaagcttcaacttattttttaactctttctggtccacgatgcctggaggcaagtgaaatatatatgacaaataatagataaaccaatttattttctgttagtgtatgtttattttttaattattaataatgtatattgtgtgtatatatgacggtgtatgaaagttggcaatgaaagctaatacaatcatgttagtcggctggatataataaagaacaagaaaggaataatagcatttgcattttaaatgtaattgaaactatttcagaagagtgggataagcccttaagaaaaatgggagatgtttaaggctgtgatttggccgacattgtaacgtataattctgtgggaaatttttcaagcaaatcaagacaggcagtgtgcgttgcattctgacactttttcattgttatgctaacttctactggcttagaatgtaactgaaaaggatgtgtgcctgtgtttttttttttttttttttttttgacgtggagtctcgctctgtcgcccaggctggagtgcagtggtgcgatctcggctcactgcaagctccgcctccagggttcacaccgttctcctgcctcaacctccggagtagctgggactacaggcgcccgccaccgcgccccgctaatttttttgtatttttagtacagacggggtttcaccgtggtctcgatctcctgacctcgtgattcgcccgcctcggcctcccaaagtgctgggattacaggcgtgagccaccgcgcccggccctgtgtgtgcgttttcatgtgtgtgattgggaaccttgagagatgtatctgaagtaatgtaaaaataagagtctcataattcctggttaatgctggcgtattgttgtcacctgccaagtgactgttaggcaataagactagaaaatatggtaccgaatgaaaggagaaatatcttatttgctgtaacaatctaatttatattaaggtaaggattttggtggctaaggaaagaacatttagctgttatttgtgtaattgtcacatattattgtgcagatttaatctcattgttaacagaatatagagtgtgaattatttgttattaaatgttactgggctttggtgtcagtgtggtataccagaaattacctctggtctgtggttataaaatctaggtcagaagctcagtttcgccacatttttgctgtgccctagatgccattttcattctctgaacttttatagcttcatgattaaaattgagttaattactattgtgtttcagaggcttgtgaatgattaagtgaaagactgtgtaaacagtaaaacactataaaaagataaagctttattatgggaaataatgggaattatataaaaaggttgataattgttatatggtaaacagagaatttctgtttggagatacatacattaaggaaaaatatatgcaacttggtatcctaaattggaaaataatattcaaatagataattgtcataattaattgaagccactcaaatacagttatttataagatctcagaagattgcagtttaactcaacataattcaaccattcatatgaattaatgatatccatatgtgaatgggattataaataaagaacaaatctttcttacttataatgataactgagtggaagataaaggactgcctttagatgatcccagcctcattgatgaacacaaaacaccagaatagagaaaaagacaataatgagtataagttaagtggtcttccaggcatccagagtagataaagaaaatgaagttctagagaatacaatactttttaaagtcacagtgacatatgtgtaattaataatttatacacttgaaaaaattagatgcaatgatattgacttaacatgaaaaccatcctgaatgcaatgcactcttgatgactcaaactcacttatatcttacaacagctcatcttaatctcttacgaatgaagaaactctaggaaactaaaaaataatatataatggatattactttttgtcagtgatgccaagatgaatgttaataagctctcttctcaactttagctcttagttatctggttattttatgctcatgtgaacagacactagaaacaaatatattaataactatgtaactaatgagaatgttgaaagtacagcatactttcattcaaaaacaaacttgcattttcattttattaatgaatataatgatgttaatggtttatataagcaggaaaaacttatatgattcactaccctacagcttcatgttctaattttgtgagtataaaccctatgtttttgtatatcaagatctggaatatgttgtatactgtatatgaccaatactttaagaacaatcaagtttttttattattattattatactttaagttttagggtacatgtgcacaatgtgcaggttagttacatatgtatacatgtgccatgctggtgtgcggcacccattaactcgtcatttagcattaggtatatctcctaattctatccctcccccctccccctaccccacaacagtccctagagtgtggtgttccccttcctgtgtaactatatagcaatttcattttacatgcagtaattttaaatgcccaaaaataaaaggaaaaggaaaaataagtcactacacaacttatatatattatgtatttgtctttgaattttgtgtgcgtatgtgtgtgtgtatatatagacagcatgcgcacacatacatacacgtgtgcaggaacacacacaatttgaggcgaaatgttgaagtaaagtaaatgacttttaaatattttctttttagcttttaagatgtctattagatccaacctctacaattaaattatatgagcatactgagggagaattgcacatttgtaaagtttctctttagtagagatttcagaattttttttctcaaatttagaggaacgaacaattcacattagtaaaacacacagcattactttcaatgaaactataatttttatgtttatgagattccattataattacattaaaaagaaaaccacttttataatatttttgcttatgtaagagtcacttctatagtaaaagagccttaaaaatgttaattcaattgactgcagaattgatcctgaaaatccagttcatttaaccttggaaatgagacatgaagcataaaacctggggtcaggatgtatgtccaaactgaatagattattttcgttcagctcaagtgctatctttcaggcaaatagactcctacaatattcagtattggagatgtttaaaacaaatataagaaagagtactgtttcagaactaaccagcgaagagatgtatacaaagtgtactctgaattggaataagtgtaggaagacaagccgtgagaatgtgagacctcagtatattgctgtgttttattgtgtgttttgctgtatttttaaaaaataagaaaaaattatcacagagtaagatacatagaagaaaataatttccgcaattcttggtacctcaaaagacctgacacactacaatgaagacttctgttgtcatcattctcagctgtgatggtggcgccatcctggtttccagcttatacctcctgacaactcggtacagaaaatgagtatcattgtaattaaagtttgatattttcttctaagtgactgatttttaatataaaagtatcacaataaagtttttccacagatatgtaattttaagttagataacattctaacatatacatggtttcaattttcttataagtctgtgaatcactcaagttaggcattgttaggttttttaaggaaaaactttgatgcccagaataactgtaacttatgcaaacacacacacacacacacacactcacacacacacgaagtaaatggtagaaatgaaagaagaagaagaagaaaaaaacattgggacattttgccctttatctttttattaagactgtcaataaatgatggtttggtttaagaggataagaagatagctgaaactctaataattggactttccaatcttaattatgctttagttcccttaccaggattaggaaacttctttgtgattcttttttaaaaataatttaatcaggaagtgacattaaattctgtttcaatgtaatgagaaaatagaaatatttatattgtcattacgatggcacttcaccagtatgtcctaatctattctctattacgtctctgaggtgggacattgttgtgagaatggacgagagcacaaaaacacggcagaccagattttctgagggttacccgctatgcagattcataaacttgttattgaatagttggcacacaagggtaggagaaaaatcccaacaacccttccaccttttccaaaaagaaaaaaaagaaagaaaaagctaaatcttatgaagctaaactgtcaacaaacagttccactgaagttgccatagggacagctccaacccagtgctgggctcgtggaaggcagcaaggtacctgcatcaagccaagatccatgaaagtgctaatgtcatttgaggccagtttcacccctacctcccataaatcattttaaaccaaatatgaattagtagtcaaaaatgaccaaacacagacgataacccaccatgaaggagatggttcatagaaatctccaagaacttcagataattcaggtaattatcagaaacatgacaagaaaaagctttgtgtaaaatacagaatacaacacaaggaataatgaaaagatgatctatgatggtgtatacttgcaaaataactaaagagtgtatttaagatttaaatatatctttgaagctagaagtactatggagattgtatatactatattagacactgtgcaagaaggaacttgtgaagctaaaaaatagaatgcaataaattagctagtctgccacatagagaaaaaaagataatctgcaagaacataagggacaaggataaaatacggagtttaacgtgcttataaccagtgtgatccttgttaatcagaattctagaatgttccattgccttatgtgacacctccactgcccccactttttctttttttttgacaaggtctcattatgtttcccaggctggcttttaactcctggcctcaagttatcctcctgcctctgcctccttaaatactggaattacaggtgtgagtcaccatgccaggtgtctcccattttttaatggtagcttaacttcacctgaagcctcctatgccactatctttataggaagctttaccgactttgtacgacttggtttaatttattcagcttaatggtccatttaaccaatattgttataaatttatgaagcttcaattctagcaaaaataaactatgtgcactcatcaaaatgtgtggcacacctatgaaaagtgatcaggatgcccaagcaattttaattaaaatcagataattaaatatg

SEQ ID NO: 3658 - DNA, 741 bp, Homo sapiens
  ENST00000581601
gtgctggaggaatacatgggttcagaccccctctatgtaggaaagatatggatctataacagatgaataaactgggacccaagcaccatcaagacagcacaacatggagcagaatggagattcagtagccatacctggggcttctttgcattgaccttccaattgggccactctgcctctaagaaaatggaccgtgaccccctagaatggctgtttctcacaagtgaattactgtgaactttttctgagaataaaaacaatatgagtagtattttttcttttcatttgttacttaataaaagaaatgatatttagggcaatattaccattacctatgcacttcctgaattatgtctctttcctttattcttgtttgtaaaacaattaatatcttcttaaaccacacgtcttcattagagatgctttataagtgaattgtgttccattaccttgaaccacagtaataattataaattaggaatacttcaaccagaaagaaatgactcatacatttgttttcatctgtaacatttattcaacagcttgataattgcaatatatacagtggtatgtggaaaatatttattaaaagacataatagaaaacttgtttataatatgtatattcaggcatttttacttctgccaatcattgtttaaatctaccttctatacttaaaattttaaccttgtaaaattttaataaaattaccctgtatgggttctaataatctggaataca

SEQ ID NO: 3659 - DNA, 8009 bp, Homo sapiens
  ENST00000577730
gaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaacttttggactgttttctattttgttcataatcctagtatttggtgtttttactacaagcacaaacatcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaatacctttgttgtcattaatttttttttcaatcagtggaagatctattaacagaatcatcaactcaaactaaaattctagaatactcaaccaaatcatcccaagggtcacttttgtttgtaagactctttattatagagaaacagagaagagaaatggcttgccagtgatcacacagcaagataccagcagggacataagaggaacatggaacacctaaaggctagtccagctgtgtcatttgggtccttctggaagcagacgcattgggcagggaaaaccttcagacaagtttgcagacctaaaacttgtaacaatagagggattgggagcaggatttggcaagagagtcttagactgcagtgcggacctggcaaaatctctgccagtctgacagggggttctagagtgaaaacacatccattaaagcagtcaggctgtggtcctctgtcatctcagtcattggtgcggggctgctaagaagagaacggtttttgactcaaaagctgaacgcaccaacttctagaggccaccttcactgtgacagaaactgcatgtttaaatactatactaacaatttataactatccggtggcttaatcaactttttattgagtttctgttgctgagaataagtcatcttttatgcgtattattacggctagtgaacactttttcttgaggtcaaagggatggtccaacatgactttaaaatatactaggacttggcacagtgtctaaaacaagtgcttggtgaatgtaaattattagtagtagttgcagtaataaccaatagtaatattccaactatcttacaccttccaaaccaaggagagattattatgttttatgtatctcttgaacaccagactcatttctagtgtactttgaagtgcccaaagattatagacacacaaatatgtctaacagaataattacagtattttttaaggagtataaaatctgtatcctcaaatattggtaatcaacaggataatcttcgtacagtggtttctgtgagcaggagataatgtctgctctactagttgcccaaatatcgcctaagtattctctttgcctaggaacacagaatgaaagcttgcatctcttgctgactttctttgccaccacagtgtcagcattttgtgtttaaaagcctatttcaggtcttgtaacatagaataaagtgactaataccttgatcctaataagattgacctatacttttagagtgtcatgaattaaactaaaaatctcaggaactatctctctctttctctctttctctctctctctctctctctctctcacacacacacacacacacacacacacacacacacaacaaacaaataaaaaacacacattttgacttgaagttttactttagcaatagacttgccaggactttcccaaccaaaagatatcaataaggttcctaacattttctaagatttaagtatcccatgctcaatttgttaaataacacattttaaaaactttattgaaatgactatatttttaaagctatgtgcattgttgtctgtttcatcaacattgacatagcagaaacaagagtactctctgctaaatagagaagaatgattaagttggagccaagtgagacaaagttatctccctctgcctacctcacaattcaaggttcccacctagggaactgatgcatccctgggtgattggacacaacatgggatcaattcagcctctactctgcctatgatttgatcaaatcatattagcaaagtgtctcttaaacatccatatatgaatattaaagagtattaaggggggcatttcttaacaatatttttatgagtatagttataagtttctaaacatttataatacgatgactaaaatatgctatttttaaattcaagtgttaaccttgccacacagaattatgacttctagggtgtaaactttaaagtgaaactgttttgaaaaaaatctgcagttaagtgtatgtgtatatatagaagaaaaggaaacttagatttactggtatcaccagtgaagcaagaatgcttagaaagatacaaatgtgtctttgggagagtctgcttaatcagatgcttaaagtaagacaagtctctgcatgagacttagaaatctcctaggagcagctggattccacactgagactcaacagagttctgggctatgctgtattttggaaaaggaaaagcgggtgctgagagctaagtagccaattactctttatagccacataaggactgaaggcaagtaggcccttccaacaagttgtattatgcgatcactggctttgcagggaatctcacgaatgtataaccttctgattgcctttttgattgaaagttccatctgagatcagggcagtgtaaccagtaataagatttcaaaaaaatcccatcactggcactgtcggaaaggctgagcatgactgaaatcctatcattgtcagtcaaaaagataaggtaacagcgggcatcactataaaagctctataaatgcacaacttaaacatgaatatcaacattaaaaagaatatatatatccttatacatatatttataaatatattcatatatataaatatgcacatatatacacaattcagttactggggataatttatagttttaatttttcatctcataatctcacgcactgccaacaaattgaaattgtggctctctgttttcatgaatctaaccttgaatttgaaagaagttgaattgagggtaaagggttttaaaagcagctttttatttgtgaacagaataatggctcataatacctgggattagaattaaatatgtcacgttgtgaggctgtacttagactttttaaatgtcattgtatttttttgtggacaaaataattgtagaatatactttgcaggaaatacttttctatattttttcaatttcaatactgttttatttgctataaaaagtgtctttgcactgttactcagccaaacagtgttgaatgtattatttgcccttgtaattattgcttcttatgataattgtagaagagcatgtctttatgatctatcatttaaaaatacatttattgtcattgtagttttagtcaacacaaatttatggattacatggtatactgttgctattgaagatattctagtcctagtattttgagcacagacctagcgttatggaggacataaaatttaaaaatttcctgacttgatggactatctgaggaaaaagaattttgtctgtcacatttattgagtatctatcagtacagaaattaagctacatggttgatacagaaagattaaatacagtagcattctcaaacttattttctttatttataaaatgtacctaatcaatctcataagaactaattgttgaattttttttttatctatggataaatactatttgagtctgggtttaagtttggttgatctgacactaaatccccttaactttcaactaaacagttatctctgtaattatgagacttttgatgataagaaatagaaactaagttatatatagtgctatggaagtactgaggaggaagtaagggaccccatatgggaagactcaagaagacgtcacggtgaaattttccaaaaagatgggaactcaagaatgggtgcaacagaaatcacagcttttccaaatactaaaagggaaaattataaaaagcaccaatggcacacttttggacattcagaaagatccagaaattaggtgcttataggaaactctaggtttgccaaattgtagtgttttatggataggaaaaatgaagttcagaaacgttataaggaattttcagggttaaattacacatcaaatatgtgagagaaacagaaattacatgctggtatttggggtcatctcctgagttgtaatgttgtaagtgtttttgtatgtattctcctccttcctttatgtgtggaagtttcatctaggtctcaaggttagtaggcatttgctggtgaaaatagtgcctttgggtactatttccccaacttgagttacctgccaccatctaattcacatcttgaatgcaagtattatttcttgcaagtatccctactaatagataatagatatttctattattatccacagattacagaagagggttgctaggaggaatatcacaagatgctgtctgaagagaaagactgtggaaaaccatggcttcaatgaactcagaggtcaggaccagaaaaggaaatgagaggtcaccaaagccaaatgttaatttcttgggatttcttctgtacatgcaaagaacttcaggccatcctatgattcctcaaaaataagaggaaaattttaacaattatgctctaagatggaccatgacaatttaggagtcattgggatcaccccccaaagccaaatgttaatttcttgggatttcttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaa

SEQ ID NO: 3660 - DNA, 9076 bp, Homo sapiens
  ENST00000585315
agcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagattgggatcctggctaatccttagataaatggtttaaatagaggaaaaaatcataattaaaaggtgctttcttagaaaaaaaaatacggacctgcaaggaatctgctgctgatatgtgtcttctgcaaggatttttatgaatgcaaatggttttttccccttcaccaataaggatcccgccacaaatgataaagcaatacttggtctgctgtacattataactttttggagttttgagaggcctcctagattatacagtacggtgaccacacattgtacataattgttggccccactcactagagactgaatagcatctttaaatattgtgtcgagccttaaaatattcacatgttcgtaatccattccagggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaacttttggactgttttctattttgttcataatcctagtatttggtgtttttactacaagcacaaacatcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaatacctttgttgtcattaatttttttttcaatcagtggaagatctattaacagaatcatcaactcaaactaaaattctagaatactcaaccaaatcatcccaagggtcacttttgtttgtaagactctttattatagagaaacagagaagagaaatggcttgccagtgatcacacagcaagataccagcagggacataagaggaacatggaacacctaaaggctagtccagctgtgtcatttgggtccttctggaagcagacgcattgggcagggaaaaccttcagacaagtttgcagacctaaaacttgtaacaatagagggattgggagcaggatttggcaagagagtcttagactgcagtgcggacctggcaaaatctctgccagtctgacagggggttctagagtgaaaacacatccattaaagcagtcaggctgtggtcctctgtcatctcagtcattggtgcggggctgctaagaagagaacggtttttgactcaaaagctgaacgcaccaacttctagaggccaccttcactgtgacagaaactgcatgtttaaatactatactaacaatttataactatccggtggcttaatcaactttttattgagtttctgttgctgagaataagtcatcttttatgcgtattattacggctagtgaacactttttcttgaggtcaaagggatggtccaacatgactttaaaatatactaggacttggcacagtgtctaaaacaagtgcttggtgaatgtaaattattagtagtagttgcagtaataaccaatagtaatattccaactatcttacaccttccaaaccaaggagagattattatgttttatgtatctcttgaacaccagactcatttctagtgtactttgaagtgcccaaagattatagacacacaaatatgtctaacagaataattacagtattttttaaggagtataaaatctgtatcctcaaatattggtaatcaacaggataatcttcgtacagtggtttctgtgagcaggagataatgtctgctctactagttgcccaaatatcgcctaagtattctctttgcctaggaacacagaatgaaagcttgcatctcttgctgactttctttgccaccacagtgtcagcattttgtgtttaaaagcctatttcaggtcttgtaacatagaataaagtgactaataccttgatcctaataagattgacctatacttttagagtgtcatgaattaaactaaaaatctcaggaactatctctctctttctctctttctctctctctctctctctctctctcacacacacacacacacacacacacacacacacacaacaaacaaataaaaaacacacattttgacttgaagttttactttagcaatagacttgccaggactttcccaaccaaaagatatcaataaggttcctaacattttctaagatttaagtatcccatgctcaatttgttaaataacacattttaaaaactttattgaaatgactatatttttaaagctatgtgcattgttgtctgtttcatcaacattgacatagcagaaacaagagtactctctgctaaatagagaagaatgattaagttggagccaagtgagacaaagttatctccctctgcctacctcacaattcaaggttcccacctagggaactgatgcatccctgggtgattggacacaacatgggatcaattcagcctctactctgcctatgatttgatcaaatcatattagcaaagtgtctcttaaacatccatatatgaatattaaagagtattaaggggggcatttcttaacaatatttttatgagtatagttataagtttctaaacatttataatacgatgactaaaatatgctatttttaaattcaagtgttaaccttgccacacagaattatgacttctagggtgtaaactttaaagtgaaactgttttgaaaaaaatctgcagttaagtgtatgtgtatatatagaagaaaaggaaacttagatttactggtatcaccagtgaagcaagaatgcttagaaagatacaaatgtgtctttgggagagtctgcttaatcagatgcttaaagtaagacaagtctctgcatgagacttagaaatctcctaggagcagctggattccacactgagactcaacagagttctgggctatgctgtattttggaaaaggaaaagcgggtgctgagagctaagtagccaattactctttatagccacataaggactgaaggcaagtaggcccttccaacaagttgtattatgcgatcactggctttgcagggaatctcacgaatgtataaccttctgattgcctttttgattgaaagttccatctgagatcagggcagtgtaaccagtaataagatttcaaaaaaatcccatcactggcactgtcggaaaggctgagcatgactgaaatcctatcattgtcagtcaaaaagataaggtaacagcgggcatcactataaaagctctataaatgcacaacttaaacatgaatatcaacattaaaaagaatatatatatccttatacatatatttataaatatattcatatatataaatatgcacatatatacacaattcagttactggggataatttatagttttaatttttcatctcataatctcacgcactgccaacaaattgaaattgtggctctctgttttcatgaatctaaccttgaatttgaaagaagttgaattgagggtaaagggttttaaaagcagctttttatttgtgaacagaataatggctcataatacctgggattagaattaaatatgtcacgttgtgaggctgtacttagactttttaaatgtcattgtatttttttgtggacaaaataattgtagaatatactttgcaggaaatacttttctatattttttcaatttcaatactgttttatttgctataaaaagtgtctttgcactgttactcagccaaacagtgttgaatgtattatttgcccttgtaattattgcttcttatgataattgtagaagagcatgtctttatgatctatcatttaaaaatacatttattgtcattgtagttttagtcaacacaaatttatggattacatggtatactgttgctattgaagatattctagtcctagtattttgagcacagacctagcgttatggaggacataaaatttaaaaatttcctgacttgatggactatctgaggaaaaagaattttgtctgtcacatttattgagtatctatcagtacagaaattaagctacatggttgatacagaaagattaaatacagtagcattctcaaacttattttctttatttataaaatgtacctaatcaatctcataagaactaattgttgaattttttttttatctatggataaatactatttgagtctgggtttaagtttggttgatctgacactaaatccccttaactttcaactaaacagttatctctgtaattatgagacttttgatgataagaaatagaaactaagttatatatagtgctatggaagtactgaggaggaagtaagggaccccatatgggaagactcaagaagacgtcacggtgaaattttccaaaaagatgggaactcaagaatgggtgcaacagaaatcacagcttttccaaatactaaaagggaaaattataaaaagcaccaatggcacacttttggacattcagaaagatccagaaattaggtgcttataggaaactctaggtttgccaaattgtagtgttttatggataggaaaaatgaagttcagaaacgttataaggaattttcagggttaaattacacatcaaatatgtgagagaaacagaaattacatgctggtatttggggtcatctcctgagttgtaatgttgtaagtgtttttgtatgtattctcctccttcctttatgtgtggaagtttcatctaggtctcaaggttagtaggcatttgctggtgaaaatagtgcctttgggtactatttccccaacttgagttacctgccaccatctaattcacatcttgaatgcaagtattatttcttgcaagtatccctactaatagataatagatatttctattattatccacagattacagaagagggttgctaggaggaatatcacaagatgctgtctgaagagaaagactgtggaaaaccatggcttcaatgaactcagaggtcaggaccagaaaaggaaatgagaggtcaccaaagccaaatgttaatttcttgggatttcttctgtacatgcaaagaacttcaggccatcctatgattcctcaaaaataagaggaaaattttaacaattatgctctaagatggaccatgacaatttaggagtcattgggatcaccccccaaagccaaatgttaatttcttgggatttcttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaa

SEQ ID NO: 3661 - DNA, 9721 bp, Homo sapiens
  ENST00000577390
aacataacgccagccccagagctcaggtgagacctctagagagaaagctcgcaggtacctcatccgcatgctgttattatctgccagcccacttatccaggagctcggtcctcagcgggctgcgcgcaccgcgcggaagggcgcatcttcacctcgtggctctggcggcagagacgcgcggggcttgctcgggagcgaggagcgaaaagttgtgcgcccacttgggtagggggaaagagagcgatcgagccagcgcgggagagcgaagggggaaggcggggagggggcggggaggggggactgcttacatgaatttccaagtggtagacctgcctctgcgctctgcccaatgagatccgtcaggggaggcacccggctcacttttccacatcacttcacagttacatttggcaggcaggcgggctcgcacgccggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagattgggatcctggctaatccttagataaatggtttaaatagaggaaaaaatcataattaaaaggtgctttcttagaaaaaaaaatacggacctgcaaggaatctgctgctgatatgtgtcttctgcaaggatttttatgaatgcaaatggttttttccccttcaccaataaggatcccgccacaaatgataaagcaatacttggtctgctgtacattataactttttggagttttgagaggcctcctagattatacagtacggtgaccacacattgtacataattgttggccccactcactagagactgaatagcatctttaaatattgtgtcgagccttaaaatattcacatgttcgtaatccattccagggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaacttttggactgttttctattttgttcataatcctagtatttggtgtttttactacaagcacaaacatcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaatacctttgttgtcattaatttttttttcaatcagtggaagatctattaacagaatcatcaactcaaactaaaattctagaatactcaaccaaatcatcccaagggtcacttttgtttgtaagactctttattatagagaaacagagaagagaaatggcttgccagtgatcacacagcaagataccagcagggacataagaggaacatggaacacctaaaggctagtccagctgtgtcatttgggtccttctggaagcagacgcattgggcagggaaaaccttcagacaagtttgcagacctaaaacttgtaacaatagagggattgggagcaggatttggcaagagagtcttagactgcagtgcggacctggcaaaatctctgccagtctgacagggggttctagagtgaaaacacatccattaaagcagtcaggctgtggtcctctgtcatctcagtcattggtgcggggctgctaagaagagaacggtttttgactcaaaagctgaacgcaccaacttctagaggccaccttcactgtgacagaaactgcatgtttaaatactatactaacaatttataactatccggtggcttaatcaactttttattgagtttctgttgctgagaataagtcatcttttatgcgtattattacggctagtgaacactttttcttgaggtcaaagggatggtccaacatgactttaaaatatactaggacttggcacagtgtctaaaacaagtgcttggtgaatgtaaattattagtagtagttgcagtaataaccaatagtaatattccaactatcttacaccttccaaaccaaggagagattattatgttttatgtatctcttgaacaccagactcatttctagtgtactttgaagtgcccaaagattatagacacacaaatatgtctaacagaataattacagtattttttaaggagtataaaatctgtatcctcaaatattggtaatcaacaggataatcttcgtacagtggtttctgtgagcaggagataatgtctgctctactagttgcccaaatatcgcctaagtattctctttgcctaggaacacagaatgaaagcttgcatctcttgctgactttctttgccaccacagtgtcagcattttgtgtttaaaagcctatttcaggtcttgtaacatagaataaagtgactaataccttgatcctaataagattgacctatacttttagagtgtcatgaattaaactaaaaatctcaggaactatctctctctttctctctttctctctctctctctctctctctctcacacacacacacacacacacacacacacacacacaacaaacaaataaaaaacacacattttgacttgaagttttactttagcaatagacttgccaggactttcccaaccaaaagatatcaataaggttcctaacattttctaagatttaagtatcccatgctcaatttgttaaataacacattttaaaaactttattgaaatgactatatttttaaagctatgtgcattgttgtctgtttcatcaacattgacatagcagaaacaagagtactctctgctaaatagagaagaatgattaagttggagccaagtgagacaaagttatctccctctgcctacctcacaattcaaggttcccacctagggaactgatgcatccctgggtgattggacacaacatgggatcaattcagcctctactctgcctatgatttgatcaaatcatattagcaaagtgtctcttaaacatccatatatgaatattaaagagtattaaggggggcatttcttaacaatatttttatgagtatagttataagtttctaaacatttataatacgatgactaaaatatgctatttttaaattcaagtgttaaccttgccacacagaattatgacttctagggtgtaaactttaaagtgaaactgttttgaaaaaaatctgcagttaagtgtatgtgtatatatagaagaaaaggaaacttagatttactggtatcaccagtgaagcaagaatgcttagaaagatacaaatgtgtctttgggagagtctgcttaatcagatgcttaaagtaagacaagtctctgcatgagacttagaaatctcctaggagcagctggattccacactgagactcaacagagttctgggctatgctgtattttggaaaaggaaaagcgggtgctgagagctaagtagccaattactctttatagccacataaggactgaaggcaagtaggcccttccaacaagttgtattatgcgatcactggctttgcagggaatctcacgaatgtataaccttctgattgcctttttgattgaaagttccatctgagatcagggcagtgtaaccagtaataagatttcaaaaaaatcccatcactggcactgtcggaaaggctgagcatgactgaaatcctatcattgtcagtcaaaaagataaggtaacagcgggcatcactataaaagctctataaatgcacaacttaaacatgaatatcaacattaaaaagaatatatatatccttatacatatatttataaatatattcatatatataaatatgcacatatatacacaattcagttactggggataatttatagttttaatttttcatctcataatctcacgcactgccaacaaattgaaattgtggctctctgttttcatgaatctaaccttgaatttgaaagaagttgaattgagggtaaagggttttaaaagcagctttttatttgtgaacagaataatggctcataatacctgggattagaattaaatatgtcacgttgtgaggctgtacttagactttttaaatgtcattgtatttttttgtggacaaaataattgtagaatatactttgcaggaaatacttttctatattttttcaatttcaatactgttttatttgctataaaaagtgtctttgcactgttactcagccaaacagtgttgaatgtattatttgcccttgtaattattgcttcttatgataattgtagaagagcatgtctttatgatctatcatttaaaaatacatttattgtcattgtagttttagtcaacacaaatttatggattacatggtatactgttgctattgaagatattctagtcctagtattttgagcacagacctagcgttatggaggacataaaatttaaaaatttcctgacttgatggactatctgaggaaaaagaattttgtctgtcacatttattgagtatctatcagtacagaaattaagctacatggttgatacagaaagattaaatacagtagcattctcaaacttattttctttatttataaaatgtacctaatcaatctcataagaactaattgttgaattttttttttatctatggataaatactatttgagtctgggtttaagtttggttgatctgacactaaatccccttaactttcaactaaacagttatctctgtaattatgagacttttgatgataagaaatagaaactaagttatatatagtgctatggaagtactgaggaggaagtaagggaccccatatgggaagactcaagaagacgtcacggtgaaattttccaaaaagatgggaactcaagaatgggtgcaacagaaatcacagcttttccaaatactaaaagggaaaattataaaaagcaccaatggcacacttttggacattcagaaagatccagaaattaggtgcttataggaaactctaggtttgccaaattgtagtgttttatggataggaaaaatgaagttcagaaacgttataaggaattttcagggttaaattacacatcaaatatgtgagagaaacagaaattacatgctggtatttggggtcatctcctgagttgtaatgttgtaagtgtttttgtatgtattctcctccttcctttatgtgtggaagtttcatctaggtctcaaggttagtaggcatttgctggtgaaaatagtgcctttgggtactatttccccaacttgagttacctgccaccatctaattcacatcttgaatgcaagtattatttcttgcaagtatccctactaatagataatagatatttctattattatccacagattacagaagagggttgctaggaggaatatcacaagatgctgtctgaagagaaagactgtggaaaaccatggcttcaatgaactcagaggtcaggaccagaaaaggaaatgagaggtcaccaaagccaaatgttaatttcttgggatttcttctgtacatgcaaagaacttcaggccatcctatgattcctcaaaaataagaggaaaattttaacaattatgctctaagatggaccatgacaatttaggagtcattgggatcaccccccaaagccaaatgttaatttcttgggatttcttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaa

SEQ ID NO: 3662 - DNA, 3728 bp, Homo sapiens
  ENST00000299345
aacataacgccagccccagagctcaggtgagacctctagagagaaagctcgcaggtacctcatccgcatgctgttattatctgccagcccacttatccaggagctcggtcctcagcgggctgcgcgcaccgcgcggaagggcgcatcttcacctcgtggctctggcggcagagacgcgcggggcttgctcgggagcgaggagcgaaaagttgtgcgcccacttgggtagggggaaagagagcgatcgagccagcgcgggagagcgaagggggaaggcggggagggggcggggaggggggactgcttacatgaatttccaagtggtagacctgcctctgcgctctgcccaatgagatccgtcaggggaggcacccggctcacttttccacatcacttcacagttacatttggcaggcaggcgggctcgcacgccggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaagattacagaagagggttgctaggaggaatatcacaagatgctgtctgaagagaaagactgtggaaaaccatggcttcaatgaactcagaggtcaggaccagaaaaggaaatgagaggtcaccaaagccaaatgttaatttcttgggatttcttctgtacatgcaaagaacttcaggccatcctatgattcctcaaaaataagaggaaaattttaacaattatgctctaagatggaccatgacaatttaggagtcattgggatcaccccccaaagccaaatgttaatttcttgggatttcttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaa

SEQ ID NO: 3663 - DNA, 380 bp, Homo sapiens
  ENST00000583483
gccaaagtatcagaccacaaaaagaatgtcactaagcttttaccgatggcaggagcctctgaaatcatcagaaatgctgacgtcaagttttatgtttcaggtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtcc

SEQ ID NO: 3664 - DNA, 778 bp, Homo sapiens
  ENST00000580044
atgcccgtaaatactcaaattggaaagaaacctgtaattgcccagtggatatttcaaatacacttaactttgctatttcaagccacagacaccaaatggacacaaaggtcattcaaactgttagcgccatggacaaagatgatcccaaaaacggacattatttcttatacagtctccttccagaaatggtcaacaatccgaatttcaccatcaagaaaaatgaagggatgccgtaacaaataatcccaaactggaaagtgtaaaacaacagatgcttattctcttagagtttctggaggctggaaatctgaaatcaaggtgtgggcagggccatgctctcctcaaaaactctagaggagaatccattctctgcttaagtttcatagatcacttgatgactcctgggttttttaaagtgaatagcacagcccactctctgtccattttcactccaaaatgacaatcatgcagatatttacagaactctactgctagatggttacagtgcagaaagagcctgccaagtgatcttctgtattaaaatgttctaattcattttgtgtataattgtaaattgttgggtaaacattcagtttggtgttagtctaggaacttccacaggaatccaccatgatgttgattttttttttccaaagccaaagtggaccttgctccaatattttatggctagatataccacattactaaatattataatatttggtaatgagtcaacactccaaaaaaatggagattattgacatcaggtggcatgaca

SEQ ID NO: 3665 - DNA, 324 bp, Homo sapiens
  ENST00000577536
ctcaaattggaaagaaacctgtaattgcccagtggatatttcaaatacacttaactttgctatttcaagccacagacaccaaatggacacaaaggtcattcaaactgttagcgccatggacaaagatgatcccaaaaacggacattatttcttatacagtctccttccagaaatggtcaacaatccgaatttcaccatcaagaaaaatgaagatcagaaatccatgagttttgcttcatagaccactacttacttggcacctgaataggaaatttgaggtctccagaaaactactcttcctcagcctgaacactgtaggtaaaa

SEQ ID NO: 3666 - DNA, 3986 bp, Homo sapiens
  ENST00000584337
ggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtaaatatctccatgttgttaatgctgaatatgtttgtatacaactgtctcatatttgactaacctgcattatattgtgcatttgcatcatttatgatctgcaaagtctcaggcaagaaacacatccaaatgggaacagagagggaattttttttctccatcagatgttatttctcttcctacttatgaccaaattggctcctaaagtggaacaacctgctgtgccacaaacccagagccaaatcactgtcttaaaatatcttgggatatggatgatagcaggagatgtcttagagtgacgggggctgaatttttactttcaaatgacaagaagcaaggtaaaacctcgtggagaggagacatttgtttcacagcaaacatatgaataccaaataatagtgaaacccaagaaggccagtggtttatagaaagttgtaggaagtgaatattgaaatctgtaaatatgtaaatatatttagataaacataagatgaacaacacgttttacatgtgtgtattagtagaacattttttgtgcctcatattgcatagatgggtcaatgaaaacagaaaaaaaagaaacataaagaaagtgagagagagggagaaggaaagggagagggagagggaatgggaatgggagtgggaggaagggagggagggagagagaaaaagagggaggaagaaagggaggaaaatagttaaacaagcaagatgaacagaaacaaatatctgctatactctgaatgtcaaaatggaaatagcctgtgtaaagttctgcaaaaccataaatgtaatagatttattttaacaaggtaccaaagtactgtatgtttaagaaatttatcatttttcaacttcctaatttatttctggatggtgacattttaatttaaataaacagcagctgacagtatgacactggagttgttaatccaactattcttgtgcctcatgtgggtgttaggaattaaacttactatttgctaagcagcttacctgacaagagtcagattttttccccctaaagaaaggactggcactgtagctgtatgctttattataaatgatcaatttgttaccctcctataaaacagtgggcatttctccgtagactactctcatgtatctggagaattagcattgtttccatctaccagaataagacacaccacaccacacacacacacacgcacacacacacacacgttaaagctaaaattctaataataaaactgattaacttttaaacatctagccatgttctcatcaaagcattcagctttagtagagatataggtttatttttataatattctaacattagcttaaatgtttcctaattttatcatgtggaattaccccctatcaatcacacgttttgagcatcttcatttgtgatcctttgagaagggagtgtgtatatgtttatatatacacatatcaatacatatcatttacctaaattggtagattgagttgtcagagagagtttgatcaaaatatggcaggttgtttcaaagatatggttgttgtgtggaccagatcattgctgagataatgtagccaaatcacagactggtaagctagactttttcaatcacatagagtctgtaaaatacttcagaatttaaataaaactccattgctcatgcaaaactcatcagataagttcaaggagtcaatgacattgatatttcaaaaactcaacattggcttcacttgcgttattgacaagcatgtttcttggatctctgggaatttgtaggtttgccctgtggattttgactgttttcaaagttctaatgatttctcagtcgttcttcttaacttcagaaaaaaaaatgcattgttttctcatctttcctatgcaaaaccaaaataaaaaattgattctttgttttatgatttttgcaaatcacaatgaa

SEQ ID NO: 3667 - DNA, 572 bp, Homo sapiens
  ENST00000582242
taaaattttattatgactctgaagtgaaattttgatggcacaattcatgactgtgaatattttgtgaattccaagtgaaatgagcaaaacaaaacaataggagattagattcactgagcttatataataaacagacataaataaatgcccataaaatttacaggttgaatctgggggactggagagtgatcccattaaggctcacaaatgggtttaaatgcacataactttcatccatcagcattatactcatttgttcttgctgctgtggtcattagtgagaagcatttatctttgtcatttcttaacagcctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttcc

SEQ ID NO: 3668 - DNA, 1528 bp, Homo sapiens
  ENST00000583382
aaggctgggaaacggtaaaaaaacgtgctgccgccaacgctgatgccaacaggaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataag

SEQ ID NO: 3669 - DNA, 572 bp, Homo sapiens
  ENST00000584966
ctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtatgtatgcttccaatttcacagatctattaaaagtcatctttagaat

SEQ ID NO: 3670 - DNA, 539 bp, Homo sapiens
  ENST00000577228
agtttgatctcagactgctgtgctagcaaccagggagactccgtgggcgtaggaccctccgagccaggtgccagatataatctcgtggtgcaccgttttttaagcccgttggaaaagcgcagtattcgggtgggagtaacccgattttccaggtgccgtctgtcacccctttctttgactcggaaagggaactccctgaccccttgcgcttcccaagtgaggcaatgcctcgccctgcttcggctcgcgcatggtgcgcgcacccactgacctgcgcccactgtctggcactccctagtgagatgaaccgggtacctcagatggaaatgcagaaatcacccgtcttctgcgtcgctcacgctgggagctgtagaccggagctgttcctattcggccatcttggctcctccctgatcacctctccaggctacactcttgagtcgacactcatagttcgctacacacagacctggatcctgggagcaaaaaaatcaagtatatcctatcaggtgatggagctgggaccatatttcaaataa

SEQ ID NO: 3671 - DNA, 559 bp, Homo sapiens
  ENST00000584506
gaatgcgctccatcacagaaccgcgacacacagcctctacatagcgtctgagttgcaggcaggggtctcacaatcaccctattctgtacgcaagaggcccttggaataaagaggaggaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttg

SEQ ID NO: 3672 - DNA, 376 bp, Homo sapiens
  ENST00000582980
acatttggcaggcaggcgggctcgcacgccggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagaaaaattgtgatgcgaatctattt

SEQ ID NO: 3673 - DNA, 6781 bp, Homo sapiens
  ENST00000623527
cccgccgcggctgcagtcgccgctacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttggctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcagtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtatgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctaggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgacaccaaatactctgcagagtcattttcctcctgcggctgagctcagatcttccaatcacgtgaaataacaaagtcctttacagtttgacagccctaggtctgaattctggttctgccattaattgtgactttgggcaagaggtcaagtctctctgggcctcactttcctcattaacacagggtgcaaagtatggttgcagagaggatgaaaagatctaatatatgtaaagtgcctagcaccggctttgtatctacttacacaagctcagtagacacttgccgtgactgtggcccacatactagaacaccatgtcctgaaagagaggaccccctccatgcatcctcaccccccaggatgtttccacccacctgtaggtccagaagcttttacttcatgctagaaaaagagaagagagtggatccagaggggagtggaggacagggcagatgccacagcatctgtggcctgtgtagccggcagcctgcatttgggcgttgacattccaggggagttaggaacaatgagaggtctctaagaacttgtggcactctgtcctcaagcagctgtccctcagaatcctgctagaaaagtgtgatcagagctgggaaggagccaccatgctctgcttctctaaggatttcggtgattctatttttagggactgaaggcgttgagggaatccaaggccagtccacctgccaggggtgttggcatctgttgacaggcagtggcacatcctgacagtcttcaaggccttggccaccaagggatggagagggagaatggagaagatgccacatgaggaatgaggcaggagactggcatgtgccacatggaggaccccttaggaaactcacaaacaacctagggaggggttctctgaagggcctagtttccagaatgaggcggtcatggcttaagcgaccatcatttgatcaataaagcagagtagcaacaggctgatgttggggacatcggtttgatgttataaaatcgtgcacatgtaccccttttgaggcctgaatgaggttcggttatttattcatttctcaataatttactcagccattcctagggtgacaagtttggagtatatcttctgtgccaggctctcttctaggtgttaggtgtatgtctctaacaagatagaaggaaagaagaaaagaaaaagaacaacattcctctctttaattgctaatcgcctgggcctagggagtcttcattttaaaagcaagtagccctgcttacaaatgtctcctcaatcaaaggcatttgccttaaacttgtatggtctaaactctaaataaataagcttctcaagggcatgacaactata

SEQ ID NO: 3674 - DNA, 2694 bp, Homo sapiens
  ENST00000332904
gtcgccgctacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttggctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcagtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgaggtgagaagactaaggtacatgaaaaatagtaacttccctggtacaacaaagtcagtaagaaaaccaaaatttaagcccaagaaaccacattccagccagggtctgttcttgcatccccactgcgaaattgccttattcaatctgagtaatgtgaatctgtactctagagtttttcaaggggcagcccaagcatcttaaaaagtatcagattctcagaaatcctccctagaccattttccctctccctaaatttctatgtttacagaagcaactgaatacttccctacccaccaacatgctcctggctctcccctgcactgcttgctgctcttccacagcccttctctcatcctgacccctctgtctcatgtgcaccaccaagcttcttttgcttggcttgaaggtctgaacatccactctcaccttcatggtagcccaggctatttcatgatggtgacaccctcaagatccgtagaccactgtattagttcgttctcatgctgctaataaagatacccgagactgggtaatttatagaggaaa

SEQ ID NO: 3675 - DNA, 4537 bp, Homo sapiens
  ENST00000372117
catcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaaggctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtatgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctaggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgacacc

SEQ ID NO: 3676 - DNA, 587 bp, Homo sapiens
  ENST00000624091
catggatggagaccggggcaaacccaatcgaattctctacagccttgtaaatgacttccctaggcaatgcaggacgatcctgtggcacgactcccctgcgcctccctgtggtcctgtgcagaacttcagggtgcatctcccttgacagggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtc

SEQ ID NO: 3677 - DNA, 700 bp, Homo sapiens
  ENST00000622973
tggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagacc

SEQ ID NO: 3678 - DNA, 3757 bp, Homo sapiens
  ENST00000459673
gataatggaatcggctagcccatgtgtaagacctacgtaaaccctggcttataggagagcatgcattctgttcctttcccaactcaatcctctcaaaataggatcaggaccatttcccatcaacccagcaagccccatatgacgtgctgatttagccagagtacacaaggattgtccccaaagcccagctctgtctgtctctccctgcgcacaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtatgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctaggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgacaccaaa

SEQ ID NO: 3679 - DNA, 503 bp, Homo sapiens
  ENST00000623399
catcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgaggtgagaagactaagaagcaactgaatacttccctacccaccaacatgctcctggctctcccctgcactgcttgctgctcttccacagcccttctctcatcctgacccctctgtctcatgtgcaccaccaagcttcttttgcttggcttgaaggtctgaacatccactctcaccttcatggtagcccaggctatttcatgatggtgacaccctcaagatccgtagaccactgtattagttcgttctcatgctgctaataaagatacccgagactgggtaatttatagaggaaa

SEQ ID NO: 3680 - DNA, 759 bp, Homo sapiens
  ENST00000449528
ccccgctgcaagttcttagattcctggaggatctgcagagtcaacattaggagtatccatccattcaccaaggccatcaggaatgtgctgaatgtgctgtaaagaagagttgtcaattgtgcacagaagataagaaatatatgatgaatagataattgaaaagagatcctccagaaagagcagaaggaagtttcttcaatgataccagtaacagcaattcaaagatgtgaatgggattaattcagggctgttgctcctgacagataagtcagtctacctgttgttgaatgacatgcagaaaagaaatttggtaagaagaaagtgatttgactttgaagaaagatgacaccacctttgatgagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaaggga

SEQ ID NO: 3681 - DNA, 175 bp, Homo sapiens
  ENST00000484035
ttcagggctgttgctcctgacagataagtcagtctacctgttgttgaatgacatgcagaaaagaaatttggtaagaagaaagtgatttgactttgaagaaagatgacaccacctttgatgagggtaaatgggaagttggtagctctgaaggtgatcaggctgcaggaagaagaag

SEQ ID NO: 3682 - DNA, 590 bp, Homo sapiens
  ENST00000446224
ttcagggctgttgctcctgacagataagtcagtctacctgttgttgaatgacatgcagaaaagaaatttggtaagaagaaagtgatttgactttgaagaaagatgacaccacctttgatgaggctgtggaagtgattctgattctctgccagggttgtgacgctgcagctttccatgaagtacttcacaagtagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaaggg

SEQ ID NO: 3683 - DNA, 565 bp, Homo sapiens
  ENST00000430760
ttcagggctgttgctcctgacagataagtcagtctacctgttgttgaatgacatgcagaaaagaaatttggtaagaagaaagtgatttgactttgaagaaagatgacaccacctttgatgagctttgatgattgccagaacaaagtgttggctctgcctggctctttgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaaggga

SEQ ID NO: 3684 - DNA, 620 bp, Homo sapiens
  ENST00000456689
ttcagggctgttgctcctgacagataagtcagtctacctgttgttgaatgacatgcagaaaagaaatttggtaagaagaaagtgatttgactttgaagaaagatgacaccacctttgatgagctttgatgattgccagaacaaagtgttggctctgcctggctctttgatcctgaggtgacttccttctaagtttttcctccaaagctaccaaataaaccctaatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaaggga

SEQ ID NO: 3685 - DNA, 4995 bp, Homo sapiens
  ENST00000380050
cgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaagttgcggagaactttgtcggagagtttcagtcgcattgctttgaagaaagatgacaccacctttgatgagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgta

SEQ ID NO: 3686 - DNA, 580 bp, Homo sapiens
  ENST00000496279
attttagcagcttttgcagcatgcatgatggtggctgaaacttggccttctataggatcccagattattatttaatggggttgtcactcaggacacttactggctttctccagtgctcttaaaaaattgaattgagcatgatgaggtgcatccccttgattaaatgtttttcctcctatgcaatcaccattagctgtttggctcccattctgtattcttctgaagcagccctgcattgcaaatcaatatctttctgaaaagacagtgtgttgtgaattgccttgacagcatatgcacggttactttggctgcaatgctgctgcagagcccggttactctgccttcgtgggaactccacagtacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgag

SEQ ID NO: 3687 - DNA, 563 bp, Homo sapiens
  ENST00000446790
gcagcatgcatgatggtggctgaaacttggccttctataggatcccagattattatttaatggggttgtcactcaggacacttactggctttctccagtgctcttaaaaaattgaattgagcatgatgagtacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctg

SEQ ID NO: 3688 - DNA, 4953 bp, Homo sapiens
  ENST00000265741
gcatccccttgattaaatgtttttcctcctatgcaatcaccattagctgtttggctcccattctgtattcttctgaagcagccctgcattgcaaatcaatatctttctgaaaagacagtgtgttgtgaattgccttgacagcatatgcacggttactttggctgcaatgctgctgcagagcccggttactctgccttcgtgggaactccacagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgt

SEQ ID NO: 3689 - DNA, 5163 bp, Homo sapiens
  ENST00000406263
cttgacagcatatgcacggttactttggctgcaatgctgctgcagagcccggttactctgccttcgtgggaactccacaggcaagtccatcgtgtttggaaaaaaaaattagattttttggagaaaataattgagctgttaaagctattgatactgaatgttagcatgtcctttgagttcttctcaacagtttttggtcttattccactgagattagcttctcttaggggatttctgggcttttttttttttgcttgcttatgcatccccctctcttggttgtagtacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatct

SEQ ID NO: 3690 - DNA, 801 bp, Homo sapiens
  ENST00000431029
agttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacaga

SEQ ID NO: 3691 - DNA, 446 bp, Homo sapiens
  ENST00000478540
ggcatgtttagtgatattaaagttgcagtgaagagttctgaatttaatttcttcttttctcagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgca

SEQ ID NO: 3692 - DNA, 545 bp, Homo sapiens
  ENST00000487145
attatgtgctgtgcagccttggacaagttacttaacaaaattgagcatctgtttccttaaaatatccttaaacagggtagagagataatatactttgccatttttgatctatggggctattgtaatgatctggtggatttatgaaattgtcaagtgcaacaaacttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaata

SEQ ID NO: 3693 - DNA, 436 bp, Homo sapiens
  ENST00000460493
gaatattccacctgccttgacatgtgtgccatcactccataatccaaccagcttcaacttttctagccctttcaggcgttaagcatccttcctaaccctacactctgaggtaagcatgtcctctcatgctcaaggaactgtgtaaaatggaatacgttataattactgtgtttataccatatagatctactaaacagaaagttgatagaagttttcccaaaattaacaacagtcctaaaagtttaccgaccttacgaacaatgagaagtgaagcagagaaaaaaattctaaactattagacatacccccaaaccaatgttcatcgtcatgctagaggaaagtctaaattatctctacattctcgttacagaaaatgttactgtagaattgtcataagaagacttaattgaagattatacagccaaattatagaaat

SEQ ID NO: 3694 - DNA, 4787 bp, Homo sapiens
  ENST00000436577
tacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgt

SEQ ID NO: 3695 - DNA, 1437 bp, Homo sapiens
  ENST00000451080
agataaggcccagactgaacactgggtccactcaaattaggaagttgagcaggggaggaggaatcagcaaagatggttgcagaggagtccccagagaggcaggaggaaaaccaaggaagtgcccacttcacagaatcaaggaggctttcaaaaagggtggcatgattatggtgttaaatgccaccaaagagtaaagcaaggatcttgctctgtcacccagtctgaagtgctgtggcacaaccatggctctatgcagccttgacctcctgaactcaagcaattgtcctacctcagccttcccagttgctaggaccacagctgcctcgttttcagttgtgcacatctgaatgcaagcaatccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggagcagaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggaggaagagacttcacttgcccgctttgccctggtgaccacctctaccggcgaaggagaa

SEQ ID NO: 3696 - DNA, 1780 bp, Homo sapiens
  ENST00000410091
agataaggcccagactgaacactgggtccactcaaattaggaagttgagcaggggaggaggaatcagcaaagatggttgcagaggagtccccagagaggcaggaggaaaaccaaggaagtgcccacttcacagaatcaaggaggctttcaaaaagggtggcatgattatggtgttaaatgccaccaaagagtaaagcaagctgcctcgttttcagttgtgcacatctgaatgcaagcaatccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaag

SEQ ID NO: 3697 - DNA, 544 bp, Homo sapiens
  ENST00000493754
agactgaacactgggtccactcaaattaggaagttgagcaggggaggaggaatcagcaaagatggttgcagaggagtccccagagaggcaggaggaaaaccaaggaagtgcccacttcacagaatcaaggaggctttcaaaaagggtggcatgattatggtgttaaatgccaccaaagagtaaagcaagctgcctcgttttcagttgtgcacatctgaatgcaagcaatccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggagcagaggaagagcctcccttttggggcagcctcatcttacttgaacttggagaagctgggtgaaggctcttatgcgacagtttac

SEQ ID NO: 3698 - DNA, 1635 bp, Homo sapiens
  ENST00000260967
tgtggccagaacaagaaccttaactgtgccaaattttattctattcaataacagctgcctcgttttcagttgtgcacatctgaatgcaagcaatccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaaga

SEQ ID NO: 3699 - DNA, 1828 bp, Homo sapiens
  ENST00000488419
ctctggcaaaaagggagagaacaaggataggagaggcagtgggggaaaggttcaagtgcgggttttctccttgaacctacaagattatgggtcaagagctgtgtgcaaagactgtacagcctggatgcagctgctaccattgttcagagggaggcgaggcacacagctgtcggaggagtcagcctgagaccacggaggctgcgttcaagctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccaggtggaagcaagaaacagcatggatggcatactgacatcggacagcatcgtactgcagcaatgcagccttgttctaggaatgtctcattttgaccttaaatccagtgtgagagcttcactgcgtctgaaaccactatgagacagaagatgattaaaatgatccttgtccccactgggatgataaagagctattctgctttgggctcaatgagttctgagcaagtctctgtgtttgctgtgagcacaagctaaggtctgcatctgggtcggcatcagcttggttgtatgagctattagccaagggagttattcagtgggttgaactaaggggaaagatattgataaaagaggctttaactgcaggcatcaattcatatggaactgtaagtccaagctcccccttttactatctggggtaacttgaggaagttacttatttcctagttctgtaatctgcaaaatgggagaaatcctatcattgtaaaagtgtttcctatgtgccagacacagaacatacacaattgctaatcctattactgcctgccaagatcgatgctgggtggagtagcccgattctacagatgaggaaacagaggctttctcctaggctcacagagaggtgtatacttattggaaatggctgaaatctgcatccaaaccttgttctcctttcattaatcatgttgtatccctctgtctcattttgcaggatgagtctgaaaaataaattatattgaattgcatctgctatagtgcctaacttttagtaggtactcaataaaagttcccattcagtt

SEQ ID NO: 3700 - DNA, 3659 bp, Homo sapiens
  ENST00000450471
ctctggcaaaaagggagagaacaaggataggagaggcagtgggggaaaggttcaagtgcgggttttctccttgaacctacaagattatgggtcaagagctgtgtgcaaagactgtacagcctggatgcagctgctaccattgttcagagggaggcgaggcacacagctgtcggaggagtcagcctgagaccacggaggctgcgttcaagctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaagagggcttctgaataacttcattcattttggcatttgttaagagattcctgggctagaaggttgatttcccaaaaagacagataagagactgacaatttaaaagaatctggagacagagctggtgcttacagagacctgccactcctgtgttcacttacaatttctcccaacaaaaggatttctgtggcaaggagaaaactagcctaaagtttagaaaaagatggtttcttggataacattgttaacaaaaggacttcctgaggactatttattattattttgtagggggcacttcctccttcactaaactggattatcagaacgtattaccacccaacccatattttagaagtttggatttggctgctgattagaaatgaatttcaggctatctcctcctactgaatcttaattgtctgtgatgatggcaacagtgatggggaatctaagcgctggtttgatggtggagatattgaataagtagttgggagcagagttccaaagatgtaatttaagccctgttgcaccaccacacacacacacacacacacacacacacacacacacacacccctcaagtaaaatgagagatctgtcttagctaacacgtgtgccgttttatacaatgactccttctaaaagcagccagggaaactcaaatcgcttctgtccagggatcatctcaggaaatgtagcagcctagaaaccagagacctctgtatatcctttggaagagcaaggaggaactaattaagagataattaaaaaatagtaactatcccccaatgtctgagatggaaaaaggaaaaagacacatgggtagcccaaatcaacctgcctgagtaagtatctgattttagtaaggcatttgacaaagactgtccagctatacctgaaagatgaaacagtgtaggctgggtgatggagcagatatatgtactcaaatcatggtgtttatttaacccagagaaaggccagccgtggtgtgctacaaggttcagtcttgagtcctattctggtcaaatatttttattaattactcgaataaatcagagtacatggacaactttatacaactccttgaagtaagtactattattattaatttatgacttccatttcacaaaagaggagactgaggctcagtgaagttaggtaactccttcatagtagcatgccagagtgaagatgcaaacctcagacctggttctccaatgttcctgacacctatcgaatttagagaatacacaactcttgcagaggcagctgctatttagtattggatcatgattcaaaagacaccttgctagaagccaatgaacagcaggccaaaacaacacttacttgcatcaaatttcatctgacttaaattcttacactttgggctacaacttaaaaaaggctatgacttagtggaaattggcacttttaagtacaatatgaattaatagtataatttcgctgtcccccagagataatgctagtaccaatcgaaagctcagggatgctactgttgacgcatcagcaagagttcttgagcagttttacctgtccatcaatacaaagagttcccacaacagtagtgggattcctctgcctctctgaagatatgagagctataggagggattcccatgttggaggttagaagagctgacctccaatgtcccgtctaattccaagattctccaataatgactttggaacagctgtgtacagattatacttggaattatgcttagatactattgctgcaggaatgaatagacaaattttgttattaaaaaattgattttattaagtggaagttgacagaattatcctctttataatggaggaacattatgcttatgcatatgcatataccttatgcatatgattatgcttgtgcttccttctttaatggatttacctattcaaaagcttaataaatgttataagactctaaaacatttaaatctttcatttctcaattttatcaaataaacattcctggaatttgtgcata

SEQ ID NO: 3701 - DNA, 2240 bp, Homo sapiens
  ENST00000434439
gggaaaggttcaagtgcgggttttctccttgaacctacaagattatgggtcaagagctgtgtgcaaagactgtacagcctggatgcagctgctaccattgttcagagggaggcgaggcacacagctgtcggaggagtcagcctgagaccacggaggctgcgttcaagctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgagtgaagcagctgcgataattatgctgtcagcctcgggaagctaatgaggagtcaccagagtggaaggttttgcatttgtgagattgctgaaggagagccgcgctgcagcttttttcgttttttatttccctttctttctttcttcctcctttttctttttctatgagttgggaaggagagtctggcagtccacagccaaattggaatccttttgattaaccggttgccttcccagcatgttctgccagatagtgtctctctctctctccctccctccctgcttttgaggagctgctgcttttgaggggcaaggaagccggagggaaatcccagcttttcatgccactgtccccaaggcaagaggatacttctccccgagagaagttccccaaatggtttggatttgagttgatttgagaataattggtaaagtatacgcactgtttattttagccatttaactgtctatgctatgacaagatctaatagaaagtagaatacaaaattgcatattataatatccgtgtgaaaatgtcttatgcatatcaacaaatggtatgatggctcccctttccagcctatttggaatatgcgattccaaatacaagacaacgagaccccagattacccacagcatttaagggcagaagtttaggccaggcgaggcagagctggcaagtttatttcttccctttgggtgtgagcagcttccagcaaacagtattatttaaggcattttatgcttttggtgcagtaataacagaaggctctctttttgttaaattgtgagatattttgagcaccccagatttatgcaaattgtgaacctgggaaaagcaatgcccaagtggaaaggggccctgagtaaattttgcggatgtgctttggtgacaatgtggctgctgcctcttgctatttttctcagatatctgtgctaatacttgtaacaatggctaccatttattaaaaacatattgtgtatcataaactaacacaa

SEQ ID NO: 3702 - DNA, 570 bp, Homo sapiens
  ENST00000460149
atacatctgacgcttccctgttcttccctgatttgtcctgcatgtctccatacctcttccatccacctcatctccccacctcacctttctttttctttgtttggctttatataggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatct

SEQ ID NO: 3703 - DNA, 514 bp, Homo sapiens
  ENST00000466337
atttgtcctgcatgtctccatacctcttccatccacctcatctccccacctcacctttctttttctttgtttggctttatataggtgctgggagtccctacagaggatacttggccgggagtctccaagctacctaactacaatccaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggct

SEQ ID NO: 3704 - DNA, 562 bp, Homo sapiens
  ENST00000517997
aaggatccgcctctttccttctttctcagcctgggttccaccccgggaggcccgctgtatgagatggagggcgggctaaaggcgggacgagactcgattgagcgcaattatgaccaatcaccttgcggaatattcggcctatagcgaaggaggagctcagaacaaaaaggagaccccacccccgccgacgtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagtcactattccaggtcctcaggatatagccgtgacctaaacacagaaatctaccctggcggagctgatcttctagttgtggcggtgaggagatagacagtaaagactaaagaaaccaataa

SEQ ID NO: 3705 - DNA, 520 bp, Homo sapiens
  ENST00000517479
aggagaccccacccccgccgacggtgaaaacctatgaaacctgggcggaggcgtgcggagtcgggtagagagcgaaatcacgcctcttcagtcagccacgccctttattcttgctcggcctcgccacagagagcaaatcagattggctgggcgacaacctcaaagggcggggctgcacacgttcactacgggaatgagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagtcactattccaggtcctcaggatatagccgtgacctaaacacagaaatctaccctggcggagctgatctt

SEQ ID NO: 3706 - DNA, 3158 bp, Homo sapiens
  ENST00000457458
ggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaa

SEQ ID NO: 3707 - DNA, 601 bp, Homo sapiens
  ENST00000522883
gaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgt

SEQ ID NO: 3708 - DNA, 573 bp, Homo sapiens
  ENST00000520295
tttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagattgtgcacgaggacttgaagatggggtctgatggggagagtgaccaggcttcagccacgtcctcggatgaggtgcagtctccagtg

SEQ ID NO: 3709 - DNA, 3144 bp, Homo sapiens
  ENST00000357227
acccttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaa

SEQ ID NO: 3710 - DNA, 991 bp, Homo sapiens
  ENST00000519758
cttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgtcactattccaggtcctcaggatatagccgtgacctaaacacagaaatctaccctggcggagctgatcttctagttgtggcggtgaggagatagacagtaaagactaaagaaaccaataaatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgt

SEQ ID NO: 3711 - DNA, 943 bp, Homo sapiens
  ENST00000520893
gcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgtcactattccaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagc

SEQ ID NO: 3712 - DNA, 1574 bp, Homo sapiens
  ENST00000517426
ggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttagtattttgtgcaatgaagccctgctcccagcctttcagagacaggg

SEQ ID NO: 3713 - DNA, 1679 bp, Homo sapiens
  ENST00000522234
actccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaagtgggtgtggggcaggaagcaggggcacaagggggcccccactcacccactccaacccacaaatctcccagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggtaccactggcctcccctttcttattggctccccagcctcctactttcccatgaccacttagtctcacttcccttcagccttgccagattttgcctaggacaccctcagtctcaactgcactctccccgagactttgcccatgactccctcattctagctgtcctttctctgattt

SEQ ID NO: 3714 - DNA, 785 bp, Homo sapiens
  ENST00000518391
taccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaacc

SEQ ID NO: 3715 - DNA, 3016 bp, Homo sapiens
  ENST00000428400
ctggcagccctgagaagagctggtgtacactgagacccccccgccctccacacaatcccacccagtggttgggtctgggcaggacaccctgacacacgctcccctccccccccccacctgggtagatgaatgggatgatgcagtggttgtcatgacgatgagtgctagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcaggtgggctacgtaggagcagggtcccagtggggctggctgtgtgggtgggcaggtactgacaaagatccccatccatgctgggtttccagaactcctgagtggctctggggtccatagtggttgagtgagcactgacaagttcatgtcagtgccccctgctaggctgtgggctttagggaacccatggtgatcaagcaaatgctaataagagacccatttccatccttgtcccttgctcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaagtgggtgtggggcaggaagcaggggcacaagggggcccccactcacccactccaacccacaaatctcccagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggtaccactggcctcccctttcttattggctccccagcctcctactttcccatgaccacttagtctcacttcccttcagccttgccagattttgcctaggacaccctcagtctcaactgcactctccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccggtgaggctggtgggtgggtgggcgttaggggccagagtgtccaaactcattttaaatcaggtctctttgtccttgtggcagacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggtaggtatagccccttgtcttcctccctgccccacccacctacctgcttacccaccaacagccatctgctctgctttcccccacaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttc

SEQ ID NO: 3716 - DNA, 2022 bp, Homo sapiens
  ENST00000518022
gatgagtgctagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttc

SEQ ID NO: 3717 - DNA, 454 bp, Homo sapiens
  ENST00000523034
ccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggca

SEQ ID NO: 3718 - DNA, 1266 bp, Homo sapiens
  ENST00000523344
gacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccggtctctttgtccttgtggcagacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttg

SEQ ID NO: 3719 - DNA, 675 bp, Homo sapiens
  ENST00000523699
cagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcag

SEQ ID NO: 3720 - DNA, 533 bp, Homo sapiens
  ENST00000523543
tttgcctaggacaccctcagtctcaactgcactctccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggat

SEQ ID NO: 3721 - DNA, 866 bp, Homo sapiens
  ENST00000493213
gttaggggccagagtgtccaaactcattttaaatcaggtctctttgtccttgtggcagacttgatagcgacggggccgacctcctcaccaagctgttgcagtttgagggtcgaaatcggatctccgcagaggatgccatgaaacatccattcttcctcagtctgggggagcggatccacaaacttcctgacagtgagtggagctggggaatggaccggccagcgtggggactgggaaacaggactgctggggccagctggcgggttgtgtaggattctggctgtgccacctctacgtggggggacatcttgttcacgtgtgtgatgggttgtatttgttatgaaaacattttttagttttcagttccttttacctttcatgaaaaatttaaaacatacataaaaatatatgcaatagcactttactttttttaaagtagacatttccttacatgtgctaaaaaatgcacaaatcataagtatactatacaatgaattttcataaatgaaacacatccttgtaactagcacaaaagtcaagaaacagaatgttaaaagctccccacccccagctcccttgcatctccttcagttattcccagccccttcccaaagggtggccactgttttgacctctaacagcaaggataagttttttctgtccttgtactttatagaaatagaatcacatgtgatgttctttttatatctggcttttaaaaactttttaatatggatattttcaaatatatgtatttatatattagtcaaagtaatatgatgagtccctaagtactccagtgagtcatcaattcatggtcaatctggttttatctatattctctctgattattttgaatcacatcc

SEQ ID NO: 3722 - DNA, 498 bp, Homo sapiens
  ENST00000520141
acttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcagccatctgctctgctttcccccacaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttca

SEQ ID NO: 3723 - DNA, 664 bp, Homo sapiens
  ENST00000462827
acttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatggga

SEQ ID NO: 3724 - DNA, 527 bp, Homo sapiens
  ENST00000462483
ttttaaaacaacaatattattatcaaacctacaaaaaacatttgctcactttccctatcttcccactggattaatatataaagcaaaccccaaacaccacccatcacctagacttaacaggtggtaattgcaataccataattcacttgacaaagttaataatgatttctttgtgtcatgtaatagtctatatttcatcttccctggttgtagctggtttgtgtatggaattgtttgacagataaaggtcaagcctctcagagaaggggcagctttttctaattcttcccatggggtcatatggggctggtcctagatgacctcatgggtcatcccccacttctatgtctcccccatctgtagctacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacc

SEQ ID NO: 3725 - DNA, 3016 bp, Homo sapiens
  ENST00000276052
tagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtg

SEQ ID NO: 3726 - DNA, 2968 bp, Homo sapiens
  ENST00000622098
gcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtg

SEQ ID NO: 3727 - DNA, 1648 bp, Homo sapiens
  ENST00000429964
tttccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctga

SEQ ID NO: 3728 - DNA, 1134 bp, Homo sapiens
  ENST00000512922
ttccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtca

SEQ ID NO: 3729 - DNA, 2435 bp, Homo sapiens
  ENST00000504648
tccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagcgggcaccgcggcgccgggtataaggagcaaagaagacacaaccctggctcccagtgatggtggcatacagggcgacagagcttgatgagagagctgaattcccagtgggtggagacctggactggttgccttgttcttttcaactgctcttctcacacttcccatctcaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcct

SEQ ID NO: 3730 - DNA, 2143 bp, Homo sapiens
  ENST00000506784
ccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccag

SEQ ID NO: 3731 - DNA, 3141 bp, Homo sapiens
  ENST00000360066
cttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagcgggcaccgcggcgccgggtataaggagcaaaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtacagaaagga

SEQ ID NO: 3732 - DNA, 342 bp, Homo sapiens
  ENST00000507067
cttcccctccccttctacctcctcctcggccagctcaggttgcagcttctctggggaactgctcacctttccggagcaggggaagctgccccgtgcccgggagggagcgggcgcaccgcggcccccaggacacgcgctacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcaca

SEQ ID NO: 3733 - DNA, 794 bp, Homo sapiens
  ENST00000462976
ccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagcgggcaccgcggcgccgggtataaggagcaaaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccc

SEQ ID NO: 3734 - DNA, 782 bp, Homo sapiens
  ENST00000478560
caggttgcagcttctctggggaactgctcacctttccggagcaggggaagctgccccgtgcccgggagggagcgggcgcaccgcggcccccaggacacgcgctacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaa

SEQ ID NO: 3735 - DNA, 591 bp, Homo sapiens
  ENST00000443813
ttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgg

SEQ ID NO: 3736 - DNA, 435 bp, Homo sapiens
  ENST00000506215
ccgtgcccgggagggagcgggcgcaccgcggcccccaggacacgcgcttgccccgcactgagaccattgaagaatccttggctgaattcacggagcaattcaaccagctccacaaccggcggaatgagaagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgct

SEQ ID NO: 3737 - DNA, 949 bp, Homo sapiens
  ENST00000419301
tcccgcgggcggtgcgcctgggaggaagggggaggtcggaggagcgggcaccgcggcgccgggtataaggagcaaaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgc

SEQ ID NO: 3738 - DNA, 351 bp, Homo sapiens
  ENST00000507240
gggaatcggggctttgttcaagaggaaggcaaagaggcttcttgaaggggtttgctgagagaagactccagtcctggccccaggagcttgagaagtgaagctgactttcccgccctccagtctacagcatcccagattcctgggatgctctgtcaacctccttctccacctccatggtctccaggtcaaggtctctcaggggtccagccccaaggcaggacccggctgcccagtccctcatgatcatgaacaagatgaagaactttaagcgccgtttctccctgtcagtgccccgcactgagaccattgaagaatccttggctgaattcacggagcaattcaaccagctcc

SEQ ID NO: 3739 - DNA, 3756 bp, Homo sapiens
  ENST00000515494
ccttccactgctcctgacctcctgtatttcagctggagagaaggtgcagctggccagctctgatgcactcttcccttcctcctctttttcccctcttgcctcctggggcatgccagagcagagaccttcaggtgtcagtatcagaggtgaaatgaggtttggacccaatcatgtcccaagggtgttggccaagctgacattcagtttacgggccttggtcagtaagatttattggctgttgacacattcaggcccttggacacaagttggtaaatttctgctggtccaaggactgcctggttctggcaccctccctgccaccccagcccttcccccagaactctctagacctccagcagctaaagggcttaggtctggggggccttcaggatcctctttgcacatcatgcctgctattatgaccaatactttgctggactaggtggtccatagagaactgcacagggcgtggcggggcgggcggtgggcagtggaggcagtgctgagggtcactgggaggaagaaggtgactgggaagaagagggtgaacacccaccctcagaggggtcaaactttgcagaagacacaaccctggctcccagtgatggtggcatacagggcgacagagcttgatgagagagctgaattcccagtgggtggagacctggactggttgccttgttcttttcaactgctcttctcacacttcccatctcaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtac

SEQ ID NO: 3740 - DNA, 954 bp, Homo sapiens
  ENST00000476153
gaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaaggtgaggcctcgggggcagggtccccccatcttggcagccacctgtccagaagcccagtgtggggacccactctcaccaccagggatccggctgctgaggtggctcagaccttcccacgtaggaaagagggagagggcaatgccatcaacgagtccaggaactgggttgagcgctttaccccaagaacagacacacactgtctgccactgtctagctgttggtataaaacccactctcaactctgaacatcagtttcccagtctgtcaaatgggagtgtgagctacctgccaaaatgcagggaggcttctggggaagctcggggttatgaatgacctctcctggtgtttgttaaagaatcaaggctgggcatggtggcccacgcctgtaatcccagcactgggaggccaaggcaggaagatggcttg

SEQ ID NO: 3741 - DNA, 1509 bp, Homo sapiens
  ENST00000505932
ccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggggtcagcgtggggcaggactgagccacgctctgtgttccaggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctggtgagtgtcctcccggcggggcccagggagaggcagccaaagagccaggtccctgtgccccatgccgggcctacgccccaacttctgtggctcgtgtgcttacacgtctttgaaacatctcccctgtactctccacccccaaggccaaggggtggcctccatacacatcctctggagtctgtgcactgcgagcccaaacccgttacttagctgtgtagctctgggcaagttacagagctcctccatgcctcagtttcctcagctgcaaagtgggattaatacctattttataagatggccgtgaggatacattgagatgacgggacacacttagtgtggtgcctgtcttgtaaggcacacgatgaagggttgttatcggcactacgcttcctgttacggatgttctccatctgatcatggttggtttgcatctgtatttctatcccaagagaa

SEQ ID NO: 3742 - DNA, 3190 bp, Homo sapiens
  ENST00000489617
ttgaggctgcagtgagccatgatcacaccactgcactccagcctgggtgacagagtaaaaccctgactctaaaagaaaaaaaaaaaaaaaagggatcaagcacatatgtctccacataggcgggcatcctgacccccgtgctcctgactgagacttcgctggcctcccccacactcactgcgtcctctgcacccctgctgtcctcccctctggatgggattccctggtgtgggtggggtccaggatgggggctgcagggtgtgcaggagaatgaggggcttgtgctgacctcactgccaagcccctgcccccatcctggtcccagccttggagcagaggctcagggccaccttccaccccacatttctcttccccctcccccagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctggtgagtgtcctcccggcggggcccagggagaggcagccaaagagccaggtccctgtgccccatgccgggcctacgccccaacttctgtggctcgtgtgcttacacgtctttgaaacatctcccctgtactctccacccccaaggccaaggggtggcctccatacacatcctctggagtctgtgcactgcgagcccaaacccgttacttagctgtgtagctctgggcaagttacagagctcctccatgcctcagtttcctcagctgcaaagtgggattaatacctattttataagatggccgtgaggatacattgagatgacgggacacacttagtgtggtgcctgtcttgtaaggcacacgatgaagggttgttatcggcactacgcttcctgttacggatgttctccatctgatcatggttggtttgcatctgtatttctatcccaagagaaggtcactctcctgaagtttcatttctggtttttcctggtggctggagaccgaggagccttcccctgagtcttgagatggcctgaggttgggtttgtggtaggggctggaggctgacctggggcttctcctgttagcctcaagcctcacccaccttggtgctctaaccagcactggagtcctgctgcccagagggtttgcagccccccagccgggcccaatagccccaccctgtgcctttcagtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtacagaaagga

SEQ ID NO: 3743 - DNA, 543 bp, Homo sapiens
  ENST00000506489
actgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtgtggggcacacagtggagagagtttgagacaacactgctgagagaattgccacatgggcgctggctgcacagacccaaacctcacagagtgaaaggggactttcctcacagagtgaaagtcgcagctttcccgagcccagggaagccccccagagaggggctgtagtgggggctgggcagttctaggagcctccactgccctgggccacccctccgccgccagagccacgatccctgcagccgcctgtggcaggtcgtcattggtgccctggtggagcagccctaggaagggcggccgcccctgcctgatgccgaccctaccccttgctcctc

SEQ ID NO: 3744 - DNA, 468 bp, Homo sapiens
  ENST00000468954
cagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggtagcccctgcgcccgccgcccctcctgctgcggccctggctctcccatccccaatcaggcacagcctgtgtccgcgccttctccttgcaggttggatacggatggcatccacctcctgagcagcctgctcctggtgagtgtcctcccgg

SEQ ID NO: 3745 - DNA, 556 bp, Homo sapiens
  ENST00000504162
ctgggatccacagagtactccacccccattgatatgtggggcgtgggctgcatccactacgagatggccacagggaggcccctcttcccgggctccacagtcaaggaggagctgcacctcatctttcgcctcctcggtcagtctcccgctgctccgtccctctcaccaccagggggcgccggaactcctccagcccaggcgcggagcgggacggggaggagcggctcggccgcctctctcccgggcggggaccccctgtggcctcggccatctttgctcccacctcatacattgcatccctttcaagtcggccttggccctgggcctcacgcaggccctccccaccctctctcgtctccccagggacccccacagaagagacgtggcccggcgtgaccgccttctctgagttccgcacctacagcttcccctgctacctcccgcagccgctcatcaaccacgcgcccaggtagcccctgcgcccgccgcccctcctgctgcggccctggctctcccatccccaatcaggcacagcctgtgtccgcgccttctcctt

SEQ ID NO: 3746 - DNA, 582 bp, Homo sapiens
  ENST00000512008
ctctctcccgggcggggaccccctgtggcctcggccatctttgctcccacctcatacattgcatccctttcaagtcggccttggccctgggcctcacgcaggccctccccaccctctctcgtctccccagggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgcactggagtcctgctgcccagagggtttgcagccccccagccgggcccaatagccccaccctgtgcctttcagtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaag

SEQ ID NO: 3747 - DNA, 1040 bp, Homo sapiens
  ENST00000484080
ccgggcggggaccccctgtggcctcggccatctttgctcccacctcatacattgcatccctttcaagtcggccttggccctgggcctcacgcaggccctccccaccctctctcgtctccccagggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccaca

SEQ ID NO: 3748 - DNA, 541 bp, Homo sapiens
  ENST00000515514
tggcctcggccatctttgctcccacctcatacattgcatccctttcaagtcggccttggccctgggcctcacgcaggccctccccaccctctctcgtctccccagggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgctgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgt

SEQ ID NO: 3749 - DNA, 716 bp, Homo sapiens
  ENST00000459862
cggtctctgggagagcgtgtgcaccagcttgaagacagtgagtactgggggtccgggagcagggccacccagaaccaaggaaaggggttggtgagtgtgggcagaagaaccagaacaaagaggccagaggccccagccccagcagagcagccccgggcaccttgcctcccctgctggggttctcattccaaattgagggggcaaacagtggaaatgagacgctgcctcgagggctcagttggtccttctgggccagtccttactggaggccagctccacgcagccctctccagactatgcacttctctcccccagctgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctccc

SEQ ID NO: 3750 - DNA, 2296 bp, Homo sapiens
  ENST00000266970
aacgcgggaagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttata

SEQ ID NO: 3751 - DNA, 609 bp, Homo sapiens
  ENST00000556464
aggggcggggcctctggtggcggtcgggaactcggtgggaggcggcaacattgtttcaagttggccaaattgacaagagcgagaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgactcgccgggccctattccctggagattctgagattgaccagctcttccggat

SEQ ID NO: 3752 - DNA, 2598 bp, Homo sapiens
  ENST00000555408
gcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgtgagtggcctctgtacccgggactcctaactggggacctccttgattgtcccccccaaccccccacgggcgggtagccgtccagggaccggaagagagcagggagggacttctttagaagtggagaggtgggttgggggccagtagaaggtgaagagtatacttatactccctggggagagtatagggtggtgtggaatccatggaaaactttcttcccaaactgagccggatcgtgcccccaaatgtgcgactacagactcggggagagaaaggaggtctctgagatgaggtccaagactctccatggagtggagttatgtgggaaccggcgagaatcgcctttctgaatgaagagccctcttcactgccccaccctcaccttagaattctctcctctttccaaagaatggcagttgaacctcactggcccctctggggaggctgggggctactcctgcattttttcccctccattacagtctccctgcttcaccttcaccaggcggctttacttacctacccctgggaaaagaggagataatggccttaatatatccaaaaaccacaccctgactacccaagaattagctcttaccatcaccctttctcttctctcactttcctagggggtgctgggtggtgtctccttgggggaaagaaatgactaggtgggggggaaaggaatatttgtaaccatattcccatctctgctttcccaacctctccaagtgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgc

SEQ ID NO: 3753 - DNA, 1725 bp, Homo sapiens
  ENST00000553376
ggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatgcacctagtgggtacccagcaccatgctaggtgctgtggggaacacagaagaaatggaagacagagtctctgcccgctgtgctcgtatctagaagtggctgcatcacaaggttgggggatgaccgcagtgtctaccccctaccccgtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaa

SEQ ID NO: 3754 - DNA, 1031 bp, Homo sapiens
  ENST00000440311
attgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggcca

SEQ ID NO: 3755 - DNA, 1367 bp, Homo sapiens
  ENST00000555357
ttgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgtgagtggcctctgtacccgggactcctaactggggacctccttgattgtcccccccaaccccccacgggcgggtagccgtccagggaccggaagagagcagggagggacttctttagaagtggagaggtgggttgggggccagtagaaggtgaagagtatacttatactccctggggagagtatagggtggtgtggaatccatggaaaactttcttcccaaactgagccggatcgtgcccccaaatgtgcgactacagactcggggagagaaaggaggtctctgagatgaggtccaagactctccatggagtggagttatgtgggaaccggcgagaatcgcctttctgaatgaagagccctcttcactgccccaccctcaccttagaattctctcctctttccaaagaatggcagttgaacctcactggcccctctggggaggctgggggctactcctgcattttttcccctccattacagtctccctgcttcaccttcaccaggcggctttacttacctacccctgggaaaagaggagataatggccttaatatatccaaaaaccacaccctgactacccaagaattagctcttaccatcaccctttctcttctctcactttcctagggggtgctgggtggtgtctccttgggggaaagaaatgactaggtgggggggaaaggaatatttgtaaccatattcccatctctgctttcccaacctctccaagtgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaaggtaatgcttctcatcagctcctctcatcatgggcatgtcttgggggactggtggcaggcaattcagggtgatattttatgattttggcctccttctgagccctcatctcctatacacacacactccccttctttttgtgtct

SEQ ID NO: 3756 - DNA, 1260 bp, Homo sapiens
  ENST00000354056
ttgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaa

SEQ ID NO: 3757 - DNA, 1802 bp, Homo sapiens
  ENST00000554619
tttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgtgagtggcctctgtacccgggactcctaactggggacctccttgattgtcccccccaaccccccacgggcgggtagccgtccagggaccggaagagagcagggagggacttctttagaagtggagaggtgggttgggggccagtagaaggtgaagagtatacttatactccctggggagagtatagggtggtgtggaatccatggaaaactttcttcccaaactgagccggatcgtgcccccaaatgtgcgactacagactcggggagagaaaggaggtctctgagatgaggtccaagactctccatggagtggagttatgtgggaaccggcgagaatcgcctttctgaatgaagagccctcttcactgccccaccctcaccttagaattctctcctctttccaaagaatggcagttgaacctcactggcccctctggggaggctgggggctactcctgcattttttcccctccattacagtctccctgcttcaccttcaccaggcggctttacttacctacccctgggaaaagaggagataatggccttaatatatccaaaaaccacaccctgactacccaagaattagctcttaccatcaccctttctcttctctcactttcctagggggtgctgggtggtgtctccttgggggaaagaaatgactaggtgggggggaaaggaatatttgtaaccatattcccatctctgctttcccaacctctccaagtgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtatggaggcttgcccaagttccacccagccccctccctctcctccccacatccaagaacaacagaactgcttcttggcccagacctatggcccttctatcacagggttctctctctaaagtagcaccaaggggaatggtgggaaaggatgcaactgttgccctgatatcaaccacagtgttaggatatcctcaaacagccttagtacctggtatacatctcttatccctgaaataagttaaagcatttctgcagctgttttagctgtagtctgcatatatttgggagaatgattccatttagtgcc

SEQ ID NO: 3758 - DNA, 665 bp, Homo sapiens
  ENST00000556276
gagtatacttatactccctggggagagtatagggtggtgtggaatccatggaaaactttcttcccaaactgagccggatcgtgcccccaaatgtgcgactacagactcggggagagaaaggaggtctctgagatgagtgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggat

SEQ ID NO: 3759 - DNA, 1136 bp, Homo sapiens
  ENST00000556656
gaatccatggaaaactttcttcccaaactgagccggatcgtgcccccaaatgtgcgactacagactcggggagagaaaggagtgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcggtgagagtgggcacctgttttccctcattcatttctcccagggaagggcttttccaggatgaaggaaggatgagaccctgaaatctgggcctcagtgtttcatttccctggttcctgctctccctgttggcacactgattcagctatgggaggatggaagtgagaattctgccttgggtagaaggagttctggtttcctgatttctgggaacacctgctgcccatttagtccactatcacatcattgaagtcaacatgcatctctccctctagcaaatgctgcactacgaccctaacaagcggatttcggccaaggcagccctggctcaccctttcttccaggatgtgaccaagccagtaccccatcttcgactctga

SEQ ID NO: 3760 - DNA, 911 bp, Homo sapiens
  ENST00000556146
atcgcctttctgaatgaagagccctcttcactgccccaccctcaccttagaattctctcctctttccaaagaatggcagttgaacctcactggcccctctggggaggctgggggctactcctgcattttttcccctccattacagtctccctgcttcaccttcaccaggcggctttacttacctacccctgggaaaagaggagataatggccttaatatatccaaaaaccacaccctgactacccaagaattagctcttaccatcaccctttctcttctctcactttcctagggggtgctgggtggtgtctccttgggggaaagaaatgactaggtgggggggaaaggaatatttgtaaccatattcccatctctgctttcccaacctctccaagtgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgacca

SEQ ID NO: 3761 - DNA, 445 bp, Homo sapiens
  ENST00000554545
cagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaa

SEQ ID NO: 3762 - DNA, 2508 bp, Homo sapiens
  ENST00000302625
agctcaggattagagcagcggagccgcctagcagccaccttcccccgccagtccgcgcgcccgggccggggctaggccccccaccgccgggtcccccggggctgcagtagcagcggcgccgcccgcggctcccgctggggcctgggcgccggccccgctctgcaggatgggcacagtgctgtctctttcgcctgcctcctcggccaagggccggaggcccggcgggctgcccgaggagaagaagaaggcgccgcccgcgggggacgaggcgctggggggctacggggcgccgccagtgggcaagggcggcaaaggcgagagccgactcaagcggccgtccgtgctcatctcggcgctcacctggaagcgcctggtggccgcgtccgccaagaagaagaaaggcagcaagaaggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccggcgagctgctgcgctgtctgggcgacttcgtgtgccgacgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatcccccgccccagcccctgacacacactcggaccccccgggaccacaaagccaccgccgctgttaccgccgctcagcgccccggctgggcggaggaggagacgcccatgcccctcaggggaaagtggagaccgggacaccagaggccgcggtgtttggatttgctgggcgtggagtggggacggaagatgagcgcgggaaaggcactccaacctcactcttcccgtctgtctgcgcccccatttctccatttctgccggggtctcccccttcccttcagcccattccccctcggttttatccatttccttgcctcctttttgtgtcttcatttttcctcctgtctgcattcctctctctctctctccctctctctcctgttcctctctttcttcctccctctccctgcctttccattttccgttccttgggtttgtgtgtctgcatctccatcttaccccttgcctgactgtaccccgtagacccctgtttctcctcctgcacctgtgtccccatctgcccttcttgttgctcctgtcatgtgtcaccatcttccctcctgtctgccttcttcctccacttgtgtcagcttgcatttttttattcctgactgagtcaccacacccctctcccctgatcaaagggaatattagtttttaatttggatcgactgaggtgccaggagaaactgcagtcccaggtatccagacagccaccaggatggtccctcgccccacccccaccgcctctccccaccttttccaacgtgttgcatgctgggagctggggggtgtgggggaaggggctgccggcttctttcaggaggctgaggtttggaggcaaaatcaacctgggagaccaccccggccgcggcgcctcagtggacaggtgggaggaaaagaaaacttcttaccttggaggagggacatcccgcttccttatccttagcttttttgttgctcctccccactgccccttttaatttatttggttgtttgcggagggaggggggaggggggtaggctgggccgggaactgtccgaggtgctgagctggggcgggaccggaatcctcccggtagggtaccagggactgagttgggcctggggccgtgtccaaggtgccaatgatgcgggccgacagagcgggccgcactgtctgtctgtccgtctgtcccggaaagaactataaagcgctggaagcgcctgcagatggtt

SEQ ID NO: 3763 - DNA, 6228 bp, Homo sapiens
  ENST00000349780
ggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttg

SEQ ID NO: 3764 - DNA, 5985 bp, Homo sapiens
  ENST00000360190
ggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttc

SEQ ID NO: 3765 - DNA, 635 bp, Homo sapiens
  ENST00000495406
tggcttcgtagaacttggaccctcatatgtgggtctgcctgatcggggcacagtcccttcccacagctgcttcccagagggcctaggaaactaaagagtgctgggcaggcccaggcctctaccctccctgcgccattgccctccctggcccacagaagtgagcctgagggatacctggacagccaggtggccgtgcacagctgtagggtgttctctgaaccggcatagcatgctgtagcctctgcatcactgtcaggtggtggcttagcggggcctcaaagaggtgttgttgatgcgttatttggccctggggtttgtgatgggtcaggtgggccctttgtacctccctctggtctggatgcttcagacctcgtgttgtctacatgtccgagccctttggggtggggttcatcctccctgcacttggctttcacacagctctcctggatatccatggccctaatcattgcattctttgctctctcctcagtggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccga

SEQ ID NO: 3766 - DNA, 549 bp, Homo sapiens
  ENST00000474262
atgtggtaccaggctttcgctcagcgtgtgaaacagaagccctacagtctggagatttatactgcatgttaaggcttgcttgtctaaaatctttttcaagactgcacgtaacagccttcatatcccccgtgtagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccg

SEQ ID NO: 3767 - DNA, 5956 bp, Homo sapiens
  ENST00000473282
accaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatgtgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtggtctcactctgtttcctgggctgttcctgaactcctgggctcaagtgatcctcccacctcagtttcttgagtagctgggattataggcacatgccaccatgcccacctcactgattgttcctgatagaggatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccg

SEQ ID NO: 3768 - DNA, 5826 bp, Homo sapiens
  ENST00000480112
accaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatgtgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccg

SEQ ID NO: 3769 - DNA, 3902 bp, Homo sapiens
  ENST00000416449
gacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccac

SEQ ID NO: 3770 - DNA, 815 bp, Homo sapiens
  ENST00000433194
attgttttttctggctctggcccttcatcactctgctgttgcaccttctgcagtgtctgtgttctgatcagactgtgggctactggaatgcaggcaccagcttgagtcatccttgtgaatctggggtcttctgccgatttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttccccca

SEQ ID NO: 3771 - DNA, 931 bp, Homo sapiens
  ENST00000480467
cttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgagtgggtggttgataagtgttggttgagttgacttgagcctctcctacaagatgactcataagcccagtgtgggtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttccccca

SEQ ID NO: 3772 - DNA, 1269 bp, Homo sapiens
  ENST00000484546
ttttagaccccctttgtcccactctttgccggtagaagtcccgtttcctcaagactcatcatgaatacacatttctctgtgacatgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgagtgggtggttgataagtgttggttgagttgacttgagcctctcctacaagatgactcataagcccagtgtggggtaatatacagaggtccaggagcgtgcctcttttcccctctgggcttgtgttgggtggcatttgggcacgagggcctcttctagccctcctagctagcttcaacatcataagcgtcttgaacgcagagtgttacctgaaacagattttacatcctacttctcattttacagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttccccca

SEQ ID NO: 3773 - DNA, 2747 bp, Homo sapiens
  ENST00000425647
aatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccc

SEQ ID NO: 3774 - DNA, 6235 bp, Homo sapiens
  ENST00000483412
ttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagaggtactgaggcccttctcaccttgaggctactgtgctttgggctgtaagaccacccgacagctggctgtaggcacaggagggcagagctcagccctctccactctggccttgtgggtagagtggatgggtgttgaagctagctctttgacccactcttcttctgaaggaacagcaggaaacatagaaggactgaggctcagcacccaggccagccgaggtccgggttcccactcacttgttcccagctatgtgaccctcagtaggccacttcaccctttgagcccatacctatctctgtaaaacatgtctctcagcacctgttgtgtggagaattgtgttgaaaattgaatgagaccatttattaaaagcatcctagcaagatacctgacacatagtaggcacccaggaaatgacctttattataatcgtcctgctagtatatgttactttttgcccactcattcagcaaacatttatggacacctctcacgtgctgggcattgctctggggatggttgttggcctcgttgctctctgtatcccaggagagataccagctcagagtgcttcaactataacgtctaatgtttcagaatcaattttgaggtgtggtgaggtgttttttttttttttttattttactaattttccagatggtttctctctattgaaagtttatctagaaaggggtcatctcacagcttttattttctcctcaacttgctttttttattcttgctgttgtgtctttttaatatagtgtggctcttaaaatcatcccctttcattctataattctagcccaaatagattttattactactagacataatttcggggtttggtgtgcaatttgctaggcttttatggccagaagcgaaaattaatttccagctcttatttagcgtgtggaatagcagcaattaagtctgccaatatttttgtttctaaagtcaagttgttattttaaactgtacctagttcttaggaagggggagggcgatggtggtggtgagtgtaaaatgcgattgagttccttcgatggctgaccctttggttgtggaagatgtcagggcttctctttgcacatgtcctcagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacggtactgcccctgcctctccccacttgctgagaatgcagctctgagcatctgtgtgtgacatgtgaacttctgaatgatgcctttgccccacagaggtgtctttccattgatagctgacatgctgtaccctaggagccaggggacctgactgctaattaattagcggtcaccttgggcaaagtggcgtaatctccatctgaggcatcttgattctcagggaagtggaatttggacttccagacaccctcagtgcctctggccttgctccctcctatccatttagtcctgcctgcatcactttgatgctgaaatttcttttagtttctcttactgcctttagaagggaacctaaacatcttaatctggctttcagtgtctttcaggatctgaaaatcatcctgataggtttaaaaagtggatctgttttgcatttgtgtgcaggttaattgcctagccctggagaggctgtggggggtacgagaaagaggaccagacacctctaccacccgcccacccagggtgtggagcaaaccagtaaatggttagactccaagcaatcaggcagcctgtcctctttgctctagagatgaaaaacaaaggcccagagagtggatggggcttgcccaaagtggcacagcaagtaggcagcagagctggagctagaaaccatttccagcttcgagtccagggctgttcctaaaccccactggactctctggagcgttgggtatcctgggattatcatcctgacacccatagggtaaatgtgtgtatccagtgggatgaggaatgccagcctgctttacaagcaagtattgtactaaagtttggactgacttttacttggatacctctagttaaaaaaa

SEQ ID NO: 3775 - DNA, 577 bp, Homo sapiens
  ENST00000468989
aaaagcatggaggcatgacacagcacgcaatgtgcagggaatcatggttaattttgtaggaaatctccagagtggtgccagagatattcctggaaaggttgcctggaactagatcatggaagactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaac

SEQ ID NO: 3776 - DNA, 611 bp, Homo sapiens
  ENST00000479584
tagaagaaggtgcattcataaacctgcttgcccctttgttcaatgagaaggccacattattactggaatccaggaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaat

SEQ ID NO: 3777 - DNA, 565 bp, Homo sapiens
  ENST00000482047
agaaaactggagccagagtccttggttttgccctggtgagacggatccagatctgcgacacagattgactcactgttgggcagggcaagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagcccttt

SEQ ID NO: 3778 - DNA, 389 bp, Homo sapiens
  ENST00000472883
agcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcat

SEQ ID NO: 3779 - DNA, 970 bp, Homo sapiens
  ENST00000481266
ggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgagtagtgggggaaggagagaaacagctttgaagagaggatccaggcacttgaagaggacctgag

SEQ ID NO: 3780 - DNA, 546 bp, Homo sapiens
  ENST00000491334
ctcgtttccgtaggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtcgtaagtacacaaaaccaggcattctcttgagtaaagaacaaggaaagtagacattggactgtgagcatcttgagctttcatatctctggggcccagaggcttccctgaactggcacaccgtaggtgctcagtattttttgtatgtattgatttgctttccacctcctttcataaacactggactagaggaattgttgtccttttggccatacttcatgagtttcatt

SEQ ID NO: 3781 - DNA, 5551 bp, Homo sapiens
  ENST00000360822
ctcgtttccgtaggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagaggaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttga

SEQ ID NO: 3782 - DNA, 1775 bp, Homo sapiens
  ENST00000395834
gatccattttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaagcaactcaagcatcccaaccttgttaacctcctggaagtcttcaggaggaaacggaggcttcacctggtgtttgaatattgtgaccacacagttctccatgagttggacagataccaaagaggggtaccagaacatctcgtgaagagcataacttggcagacactgcaagctgtaaatttttgccataaacacaattgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggctgtctccacatggaccctactcaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaagttgcagtacctaccccagctaactggcagcagcatccttccagctttggataataagaagtactactgtgataccaagaaacttaactaccgttttccaaacatttaaaggagctaggagacatgattttaaaaaaggaatcaatagatgctttgaagaaaataaaacttatacagttgattgaaaacaattacaatgttgaaaacacaccaggagaaaacataagcaagaaactgggaggccaactggcaagatatgaagggaaattccagatccagtcttccatgcttgatgatggtgtccagaaaagaaaaaacctgtttggagttgcacttgtatttcagtttatgtaagtagccgaacttatggacagaatatgaactgtcccatacctctggcaaaactagatgatatcaaaaagatttatgcttcagttgtaccacatgccacacaagaaaaatgaaccacaaaatgcccatatatatttcctcggatctctgttgcctgagtcctatctcctgcctctcagattgtttcagcatcatatttaagatagttctatttcttgaaatcaaaatgtttaaaatcccatttcctgcttgctctatttcttgatttttatattttaaaacattttgagggtaacacttaggttcaaaatatttaaaagcatatgaattatcacaaaagcttggtaatttataatttaattatatgtttccacatttcatccttactttatcagtaaaggatacaccttagtcacttttgcaggcaa

SEQ ID NO: 3783 - DNA, 210 bp, Homo sapiens
  ENST00000525911
gggatctcattcctaggcaccagcaagtgtttagcacgaatcagtacttcagtggagtgaaaattccagaccctgaagatatggaaccacttgaattaaaattcccaaacatctcttatcctgccctggggctcctaaagttgcagtacctaccccagctaactggcagcagcatccttccagctttggataataagaagtactactgtg

SEQ ID NO: 3784 - DNA, 745 bp, Homo sapiens
  ENST00000534267
ggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggctgtctccacatggaccctactcaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaaggttataatttgaaatgatctcctacctgccacctggtacagagagttggaatctagacttgaggatggcagttgtggctttcagctccagcatcctcattccagcactaggagacaggtcataggatctatcaaccagggccccagggacatctgtctcctgaagccccctctccctgaatcctaaaggtgcccttgtcctgctgcttcctgatgccacacaggggccagggtttccagcctgcatgagcacaggtctcaacaaggtacatgagtatgagtccagctaaggagactttttgggctttggaaaatgaaatcagattttccccatgca

SEQ ID NO: 3785 - DNA, 2209 bp, Homo sapiens
  ENST00000216378
acagcagaagactgccgtggaaccttccctactgtagaggaaagtgctgactttaagcaatttctgcagtcacgccttcctcttctttcctttctccctctcattcattcactgacgccgcagcactgatcagcacagacacagaagatgcctccaagggaccaaagggaataaccgcggttctgaggaccgtgacaaacactcatcgttgggtggggctctagtgcagtccgttggtgccaatattttataagcgacgttttcaaactatgtgaagatcctttcttttcttttctttctttcttttttttttttttttttttttttttttgagacggaatctcgctctgtcgcccgggctggagtgcagtggcgcgatctcggctcactgcaacctgcgcctcccaggttcacgcgattctcctgcctcagtctcctgagttgctgggactacgggcgcccatcaccacacccggctaattttttgtatctttagtagagacggagtttcagtatgttggccagactggtctcgaactcctgacctcaggtgatctgcccgcctcagcctcccaaagtgctgggattacaggcgtgagccaccattctcggctgaagatccattttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaagcaactcaagcatcccaaccttgttaacctcctggaagtcttcaggaggaaacggaggcttcacctggtgtttgaatattgtgaccacacagttctccatgagttggacagataccaaagaggggtaccagaacatctcgtgaagagcataacttggcagacactgcaagctgtaaatttttgccataaacacaattgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggcagagtaccaattgcttcaagaacagaataaggtggagaaaatgatttttcattactacttctagaaactatttatttaatatgtgagtgccatttaggaatgactggaaggaactaaaatcatgactggtgtgttttcctgccttttcccccttcttattgcaactgaagtttcatctttcaaagaagaaaaaaatgacattaataagttaatacaattttgaagaagtaagaagaaggaattttctgttcttttagggctgtctccacatggaccctactcaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaaggttataatttgaaatgatctcctacctgccacctggtacagagagttggaatctagacttgaggatggcagttgtggctttcagctccagcatcctcattccagcactaggagacaggtcataggatctatcaaccagggccccagggacatctgtctcctgaagccccctctccctgaatcctaaaggtgcccttgtcctgctgcttcctgatgccacacaggggccagggtttccagcctgcatgagcacaggtctcaacaaggtacatgagtatgagtccagctaaggagactttttgggctttggaaaatgaaatcagattttccccatgc

SEQ ID NO: 3786 - DNA, 2982 bp, Homo sapiens
  ENST00000356146
atggagctgtccactgatactggctggaatcagaagagtaatttcccgccttgtgactctcgtgtctccaaagaagaagcccaactccctttcccaacacctagcagctacggtgcagactcctccaaccagacttacgcacacaagtctcagtctgaaagagagcagcacaaggaagtacgtgctgtcctgaaccattgttctggcttggatggtggagaggagtctggcctttgtgggacaagtacccgcattgatgctggcactgggaacgggacggatgataaagtcactgatcagcacagacacagaagatgcctccaagggaccaaagggaataaccgcggttctgaggtgtggggactgctgttgcagggaaatgtggaccgctcaggaggggctcctagcgcaggcgtcttgctccgcagacgcggttacagctgcgctttgcacggcctgcggaagtttgcaaatctagcaggtctgctctcccggcagcaggactcggcccgcggcgtgagccaccattctcggctgaagatccattttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaaggccccaagcccctatgctgctgaaccttctctctgtggaatgaaaatggtaagaagaggaaagaaagaatttctgccagcagtggcagaaaaagtagatgctcctagcggagttggaggtcaaggacaggacagtgtcactgtgggatccctgggcagacgttctacctatggcagaaaacaagaaaaacaagtgagacaaagagaaggaatcatctactgctatgtggcagttttgcttcggatttactattttgaccagggttgtgttgccagggaggaagagcagtttcaggagcttgtgtttggccctttctgccatattggctcttacttcacaggtcatagaaccaatgtgaggccttacattttactactatcacggcccagccccttcaagacggctgctggtacctatgaggcaggtcttgtcattcttgagtgcagttatttcctcgcagagcaagaaccttattgccctactcaggcactgcaacaacctcatcctattataggtccgtgggccctagaaggaggtggggtagaatctaaggaggacaggcatccccctcctaaggaggcacctgcatcatgtgagggatttttaaggtctgcagtgccgaagcaagcttacaccccattcaaaaccagccctgacaaaaggcttagtgactgtgttgctacacctccctgggctcctcccaccccacttatcatcagcagtggggtccttgttgccatctgctccatgattgatccagttccagaattccattctgaaggcctgctagctaaggccacttcaggaagtgctggaatcctggtatggatatttttatgcaatgatgcttttatttatggaaagtatattctcagaagtggagtgctatgggttcgtggtctccctggcttcaagagtgaagctgcagccctttgccataagtgttacagcagtgcggacccaaagcgtgagcagcagcaagatttattgcaaagagtgaaagaacaaagcttccacagtgtgaatggtgcccaggctagacataaaggttctccaagtccccaccagactcaggagcccagctggcctcacccagtggatcccacaccaggccacaggtggagctgcctgccagtcccatgccgtgcgcccgcactcctcagtccttgggtggtcgatgggaccgggtgctgcggagcagggggcggttctgatcgtggaggctcggccgcgcaggagcccacgcaactcaagcatcccaaccttgttaacctcctggaagtcttcaggaggaaacggaggcttcacctggtgtttgaatattgtgaccacacagttctccatgagttggacagataccaaagaggcatatgcaacatctttgtgtgcactggaagaagacttggtgagcacacagaggccttgtccaagaaaaagaaaaaaggaggagggggtcccttcctgaagttgagggcagcctcttgcaggatcaccctgtttaagaatgttggctgtgggctggaaaccacaggtgatttgagtctaaattctggagggggggccgcatctcgaggggtggctgcagctctcagagcacttgtgtgtgggacagagctgacatctagcgactctccccagaggtgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatgtccctctgcctgtcagtaaccctgacagagggaggcctgcttgcttctggggctgtgaaacgctcacagatgggctccagcgtatcacaggcaaccagttggcctcatccagacattgttgctgagacagcagagctcgatgatatagcaatggcacgtcaaaccccagtgatgctcagattcaaccgacagaaagaacaagagaaatatttaagctatggagcatga

SEQ ID NO: 3787 - DNA, 487 bp, Homo sapiens
  ENST00000542671
ctgtatttttctctgctaagaccggctaccctactttcattttcctttcactcttcttggctcttttgggccttttaggaatttgggatgattcaggctctgacaggcatgtgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatgg

SEQ ID NO: 3788 - DNA, 673 bp, Homo sapiens
  ENST00000529347
atttgaatttcagataaacaagcataacttttagtataagtacatcccaagtgcttcatgggatgtattatcctaaaaaaattatttgtttatctgaaattcaaatttaactgggtgtcctgtatttttctctgctaagaccggctaccctactttcattttcctttcactcttcttggctcttttgggccttttaggaatttgggatgattcaggctctgacaggcatggtactagatttattttaggctgctcttttgctgttgtccaacaggccaaggagagatttaaatgatttatccaatatttgctaaatagtcatgtgtttcatttatcccatatatagttcagccttaatattgtttttgttttgatttgttacactagtgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaaga

SEQ ID NO: 3789 - DNA, 573 bp, Homo sapiens
  ENST00000528197
atctggaggtggggcatgctttagagacaggaaactgaacacatcctgaaatgaaagggagtgtgagccttctaggaagtgagagaaattcagtgggtccagaaggaagttataagtgttggggctggagagcttggagtgccctcagttctaagatccaaacgtgtctggaattggtgggttcttggtctcactgacttcaagaatgaagccacagactctcgcgcaactcaagcatcccaaccttgttaacctcctggaagtcttcaggaggaaacggaggcttcacctggtgtttgaatattgtgaccacacagttctccatgagttggacagataccaaagaggggtaccagaacatctcgtgaagagcataacttggcagacactgcaagctgtaaatttttgccataaacacaattgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagct

SEQ ID NO: 3790 - DNA, 704 bp, Homo sapiens
  ENST00000531052
gttgctgggactacgggcgcccatcaccacacccggctaattttttgtatctttagtagagacggagtttcagtatgttggccagactggtctcgaactcctgacctcaggtgatctgcccgcctcagcctcccaaagtgctgggattacaggcgtgagccaccattctcggctgaagatccattttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaagcaactcaagcatcccaaccttgttaacctcctggaagtcttcaggaggaaacggaggcttcacctggtgtttgaatattgtgaccacacagttctccatgagttggacagataccaaagaggtgaccacagcacagacttttcatatttcagaatgttaatttacatagccagagagagccaagaggacagacacctcccttcagaaagtcatcgatacagagaaattatgttttcaaaggagaaaacatttcgtatgttgatatttgatcttttgacagcttgcaagtgacacttcaattaaacttgttaatataagttactcatgg

SEQ ID NO: 3791 - DNA, 311 bp, Homo sapiens
  ENST00000530553
gagctgggcggaagaaggcgaggcgggagccaggcccgtccctgaccgccgcggcgccgtgagtcccgggcgggcaaggaggcgcgggccgtccctggccaacacgtggcaccgctccatgctgcgcggcgcggctgaggaccgtgacaaacactcatcgttgggtggggctctagtgcagtccgttggtgccaatattttataagcgacgttttcaaactatgtgaagatcctttcttttcttttctttctttcttttttttttttttttttttttttttttgagacggaatctcgctctgtcgcccggg

SEQ ID NO: 3792 - DNA, 192 bp, Homo sapiens
  ENST00000534566
gagccgagctgggcggaagaaggcgaggcgggagccaggcccgtccctgaccgccgcggcgccgaccgtgacaaacactcatcgttgggtggggctctagtgcagtccgttggtgccaatattttataagcgacgttttcaaactatgtgaagatcctttcttttcttttctttctttcttttttttttttt

SEQ ID NO: 3793 - DNA, 604 bp, Homo sapiens
  ENST00000459970
aggaaggggatggtaggagacaggagacctctaaagaccccaggtcaccagacttctctgagccccagtttccccagcagtgtatacgggctatgtggggagtattcaggagacagacaactcactcgtcaaatcctccccttcctggccaacaaagctgctgcaaccacagggatttcttctgttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactc

SEQ ID NO: 3794 - DNA, 2180 bp, Homo sapiens
  ENST00000244741
gaggcgggcccgggcggggcggttgtatatcagggccgcgctgagctgcgccagctgaggtgtgagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgtaa

SEQ ID NO: 3795 - DNA, 793 bp, Homo sapiens
  ENST00000373711
gagcagctgccgaagtcagttccttgtggagccggagctgggcgcggattcgccgaggcaccgaggcactcagaggagaaactgcaagttgggacttgtccctaggaaaatccagttgctgccaaggtcgtgcagtcactcagccctggagtcaagccagagcaggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcct

SEQ ID NO: 3796 - DNA, 616 bp, Homo sapiens
  ENST00000478800
gctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtg

SEQ ID NO: 3797 - DNA, 553 bp, Homo sapiens
  ENST00000462537
cgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcagggtgacgcgcagccggagtggaagcagttttggcgggcgagcagcgccttgcaggaaactgactcatcactactccctccagcggtccgaggctctgcccacgcacctcccactccgcgcgtgatttcctggaggccggcgccccctcccggccctggcgggaatagcacacaggctttcccgcggagtggggctggccggcgcgaaccgccgcggctactcctgggctcatccgagatcaacccctatgccattaccaccccttcaaaggagcactccttaggttcaacagtattcactgagctcttactggaaattaaaatatggctgaagtctaaggcaggaaggccaataaaggaggctatttttaattgtttctaaaac

SEQ ID NO: 3798 - DNA, 2267 bp, Homo sapiens
  ENST00000405375
agctgaggtgtgagcagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgt

SEQ ID NO: 3799 - DNA, 2102 bp, Homo sapiens
  ENST00000615513
aacatgttgagctctggcatagaagaggctggtggctattttgtccttgggctgcctgttttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgt

SEQ ID NO: 3800 - DNA, 2104 bp, Homo sapiens
  ENST00000448526
ggtggctattttgtccttgggctgcctgttttcagctgctgcaaccacagggatttcttctgttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgt

SEQ ID NO: 3801 - DNA, 1860 bp, Homo sapiens
  ENST00000250535
agcggcggaggtggagcggggagaggcgttaggccgggcggctaaaacgcgccgttaaagtgggggagagattgcgcggagcccacgcgatccctgggacgccggagacaacggggctcttgggaaggcgcggagcccggggaagccggggatgtgcgcgtgagccgtgcccgcagggtctccccgcctccgccacctttcttgggtggctctccgcctcgtcctccctccgagggccgttggtacattcctagtgactccaagcgcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaa

SEQ ID NO: 3802 - DNA, 752 bp, Homo sapiens
  ENST00000502631
agatctgaacctgatttgtgtgtgcaccgcgtctccagcgatcccggatccactgcgctgccaggggcctgggggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgatgcaggagtaggggtggagatggatagtgatcagggggaaggatgttgcaagtacaaggaagagcacaagtgaagattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccct

SEQ ID NO: 3803 - DNA, 273 bp, Homo sapiens
  ENST00000504877
cctagcgctgtgaaggattctgttctctgactttgggagggccagtgcagaagaatcaagacagaatatgctcccgtgtgggccaggctgtgaattctttgaaagaagctgcagagaagcaacaaagattatcctaagacttctggaggaagaattaggatccttctgcaggaactcagtttactgtgaattgaaggtatacccgaaatcttgtggatcaaggaaatggaaaatttaatctgatgattctctgttggggtgaaggacatggca

SEQ ID NO: 3804 - DNA, 557 bp, Homo sapiens
  ENST00000504613
agatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacagtcgtggtcgtggtttgcagtttgttgttggtggtggcagtggtggtggttggttgtggtatacccgaaatcttgtggatcaaggaaatggaaaatttaatctgatgattctctgttggggtgaagga

SEQ ID NO: 3805 - DNA, 3419 bp, Homo sapiens
  ENST00000328908
ggagagaggacctatttctacctaaggacattcccggaaggcaatgggtttcaaacaatatcctgaagagactcatctcggggaactaagcaggtggtcatcagagaacacagagcccccggaagaattttatgacatttcaggcaagccacaggtcagcctggggaaaaagcaggaagaaaaactggcaatacgagggcccaacccaaaagttattcctgaagagaaacaacgtgtcagcaccagatgggccttcagaccccagcatctccgtgagcagtgagcaaagcggggcacagcagcctcccgctttacaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacattt

SEQ ID NO: 3806 - DNA, 614 bp, Homo sapiens
  ENST00000491864
cgagggcccaacccaaaagttattcctgaagagaaacaacgggcctgagcagtagcctgcctgatgatgatcaagcagagccctgcaagtttcaagaggaatgtcagtgactcttcactgaaaccccccagtgtcagcaccagatgggccttcagaccccagcatctccgtgagcagtgagcaaagcggggcacagcagcctcccgctttacaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaaga

SEQ ID NO: 3807 - DNA, 690 bp, Homo sapiens
  ENST00000440139
agacatgcctggtttggctggtgattgggaaaagaggaggatctcagatttcaggttttagttatcattctcccgagatgggaagaggctgtgattcttgatctgaagagtcttatcgtcggtagaacttgccatcgatgatcaattgtttggatttgaggaggagagaattgaattatgttggcctacaacaacgggagcaggtcaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtc

SEQ ID NO: 3808 - DNA, 773 bp, Homo sapiens
  ENST00000483019
tcccgagatgggaagaggctgtgattcttgatctgaagagtcttatcgtcggtagaacttgccatcgatgatcaattgtttggatttgaggaggagagaattgaattatgttggcctacaacaacgggagcaggtcaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagc

SEQ ID NO: 3809 - DNA, 2184 bp, Homo sapiens
  ENST00000397588
cggagaggggagccgcgatccggccgcgccgcccgcacgccgccgcgcccgccccagcccgcccggccccgcggcggggcgcgatgagcccgagcgcgagccggcccgccggggagtgagcgcggggcgcccagggcgcgttgcgtagctgctcctgcgcacaaccccgccgcgccgccggcccgcactggccgcggagtgcaagaggctcgtccgtgcccagcgcccggccggccgcgggagcaggaagcgcaggccacgcaggacccaactgaaacaaagtgtcggccgcccggcgccggcgcccgccccgaccctgcccctcccgcccgcaactccgccgcccaccatggcttccgaggagctgtacgaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagct

SEQ ID NO: 3810 - DNA, 1764 bp, Homo sapiens
  ENST00000472453
gggagccgcgatccggccgcgccgcccgcacgccgccgcgcccgccccagcccgcccggccccgcggcggggcgcgatgagcccgagcgcgagccggcccgccggggagtgagcgcggggcgcccagggcgcgttgcgtagctgctcctgcgcacaaccccgccgcgccgccggcccgcactggccgcggagtgcaagaggctcgtccgtgcccagcgcccggccggccgcgggagcaggaagcgcaggccacgcaggacccaactgaaacaaagtgtcggccgcccggcgccggcgcccgccccgaccctgcccctcccgcccgcaactccgccgcccaccatggcttccgaggagctgtacgaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagaga

SEQ ID NO: 3811 - DNA, 2139 bp, Homo sapiens
  ENST00000449732
actgtctggcactccctagtgagatgaacctggtacctcagatggaaatgctgaaatcacctgtcttctgcgtcgctcacgctgggagctgtagaccggagctgttcctattcggccatcttggctcctccccaaggcttaggtttctaagtcagccacaaatgctacccaaaactacataaagaagaaaaaagttgcatagaaccaaaaagttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtat

SEQ ID NO: 3812 - DNA, 3241 bp, Homo sapiens
  ENST00000343762
ggttaaggagggaggggaaacaaaagcagtgtgctccaccaggctcctgcctcggctctaaggaaacagaggaaagcaaacgggaatactctggtttagtatactgcccgcttctggagtggacattgatttaaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacatttgaaa

SEQ ID NO: 3813 - DNA, 732 bp, Homo sapiens
  ENST00000469671
cttaacctgcatagcctataaactgttttaagaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgtgagtacctttttaaaaaaaaaaaaaaaaagtcattctagaaagcttcctgaagaa

SEQ ID NO: 3814 - DNA, 8159 bp, Homo sapiens
  ENST00000570137
ctgtcattctgcaaaaacacagtttactcaacacaccacacacactcgcacacacacgcgcgcacacacacgcgcacaccggaccccgcgcgcacacgcacggagggcgcgagcgagcagacgcgcacaccggcgagccaagttccgcagcctggcatggcttctggggacctttacgaggttgaaaggattgtagacaagaggaagaacaagaaaggaaaatgggagtatcttatccgatggaaaggctacgggagcaccgaggacacgtgggagccggagcaccacctcttgcactgtgaggagtttattgatgaattcaatgggttgcacatgtccaaggacaagaggatcaagtcagggaagcagtccagtacctccaagctgctgcgtgacagtcgaggcccgtcggttgagaaactgtcccacagaccttcagatcctggaaagagcaaggggacctcccataaacggaagcgaattaaccctcccctggccaagccaaaaaaagggtattcaggcaagccctcttcaggaggtgacagggccaccaagacggtgtcttacaggactacccccagtggtttgcaaataatgcccctgaaaaagtctcagaacgggatggaaaatggggacgccggctctgagaaggatgagaggcactttggaaatgggtcccatcagcctggcttggatttgaatgatcatgttggagagcaagatatgggtgaatgtgacgtgaatcacgctacactggcggagaacgggctcggctctgctctgaccaacgggggattgaacctgcacagtccagtgaagaggaagctggaagcggagaaggactacgtctttgacaaaaggctcagatacagtgtccgccagaatgaaagcaactgtcggtttcgagacatcgttgtgcggaaggaagaagggttcacgcacatcctgctgtccagtcagacctcggataacaatgccctgacacctgagatcatgaaagaagtccggcgagcgctctgcaacgcagccacagacgacagcaaactgctgctcctcagcgcagtggggagcgtgttctgcagcggcctggattattcctacctaattggccggttgtccagcgaccggcgaaaggagagcactcggattgcagaagccatcagggactttgtgaaggcctttatccagtttaagaagcctatcgtggtggccatcaatgggccggccctgggcctgggtgcctccatcctgcccctctgtgacatcgtgtgggccagtgagaaggcctggttccagacgccctacgccaccatccgcctcacgcctgctggctgctcctcctacaccttcccccagatcctgggcgtcgcgctggccaatgagatgctgttctgtgggcggaagctcaccgcccaggaggcctgcagcagggggctggtgtcgcaggtcttctggcccaccacgttcagccaggaggtcatgctgcgggtcaaggagatggcatcctgcagtgccgtggtgttagaggagtccaaatgcctcgtgcggagcttcctgaaatcagtgctggaagacgtgaacgagaaggaatgcctcatgctcaagcagctctggagctcctccaaaggccttgactcccttttcagctacctgcaggacaaaatttatgaagtctgaggggccccagctcacgggcccccaacttccagctctgccctgtgtttcggaaaccagagcacagtgtctgccccggccaaggagtttgtcaaggtgtctctttatacgtagggttgtgtccatttcctcgtgtcctttggttgctcctccttggtttgattttgtgtaatggatggaaaacgcagcatacttggcctcccccacctccctgcccttcctggccagagagctgtccaaggctgtatcttcccagggctccgccaagcaccgctgtcctttccccacttgctgaaatgcaccatgacggtccaggaaggggaagaccactttcacattcttctgactcaggctgtgtctacacagtgcctctgacttggagacttggccatcatggctctctctggttgtatttagatcgggtgtcagaggacgaccaatcttagggaatttccagaccaatgagcaaaatgattgtgcacacctggcctcagtctcctttccgacgcaaatctgtgtgactattagggcttggtcttaaaacccaattgagtgatttgcaaacccagatattgtacatttagaaatgttttgttaaatatatatttttaaaacaatgtaagtggaaattctgataatttatgtgtattatatgtaaagctagttttgcaaaaacaaactactagggaaatgttttttctttccttggacttgttttatttatttatttttgtttatatattgtgatgtctgttgttcacacagatactattttcatactaccctggaccaaatcccacacaaggttcatgccgtttggtgcattctagcaatgaaccatgtagaaataaagtttagagagatgaaaacagaaggatttctgtggacaaaaggaatagcgctgcacctctgtgtaaaacggttctcagctgtaataatagaatactagttccttaggtttgtccttaggagacatcttgggagagttttttcttccctctgctgtctttaaggagttaaagggccctcttagcctgaatgatcctgaaacagacccagtcccaaattgcgtgatgttgggcaggagtggggataggccctacctgagaatagcatactgtctagaataagacttctttctttggggcaaatgactgaacttggatcctgcagtctgttgcttccatgtgatcagtgatttctggtattggccagggggatggggaagagttcccactctgctgagctgtctggaggtctgaatcttttccctccagaagctgaaatgactcatctgttttctagtttttttatgtacatagggagcaatgaccaggaatgagatctccttgcccctgtgcccctgggctgcaaggggactccagcagctgtgttagaccatcagattcaagtccctggattaactacagagaaggagggattgggggttgtggttttgagtggtgaggagaaagttcaggaaaacctgaagttgagagcagacaaatggaagggatgtgttctgcgtgaggtttaaaccatgggtcaagcacccagaaaaagctagattctcagattctcaggatggagggatttttttccgtttctatcacagcccctgcgtattcctggaggcccttggccctccccttcttcccctttcctgttgggcaccagcctttcttggcccttctttgaagagagtggaataaggcagcaagaagtgggcacagcttatggaggtgaggcaggcttagaagagagagttctggtgacagttctctaactctctgtggtcctttatcttttcctggcaatcaggtgcactgggcagggcaggtggaatgtattcgtggccctgagctttgagtttcaaagaacacgttgatagtctacaccagatctagagacatggtcctttaagcagtgaccctcaagttaatctggactgctggtccttctgatgaccttggttccctccctggaaagcgtgtctcctttaagagttcatgagggtcaggaaggaggggaaacctctccttcagccagaggaggatggaattaaagtcctgtgcaccctcccctttgtccatgtaggatcctgtaaggacttcggacctgtcctacagggagttactatagggagacacctgcttttgcccaaatgcctgttgtcacagctctatctggatcttatctcctcctttgagaaagcaaatgtgagctttccaaaacccttagatgaccctggttcttacatattgtggcagacagtgtcttcactactgctaaattttcattagaaagagccccctcttttctgttgaacttctgattgggcgcagttatattcagcatcggttgaagtggggtcaggattctccttggacatggaaggggatgtttagaaattcctttagatcagtgtccaccttcattccctgcttgaaagaactagaaatgcttcagctttggatgtactatcaaatccaaacttctaaacatttcaaggatctctgaagattaaggtaggaatgtgaaaccatttctaaggtggaaatcttgctgttaagtcacaggtcctgggtgtaacgggggtggtgaaagtctgtattttggttgtttccatacagtcagttccaccaattgggtgaaagcaggtgaaatctttttgctgcagggtggactgaatttttcactttctgggtagttgttttgatcatgtgtaggcgaattccaggtaacttacagcaaatagatttgggatggaaaataccagacctctggttgtgtcagggtttatcctaatagctttcctgagacagagctcagactttcatttttgatcttccaccccagggccccctctctgtctatgggatcctttctcccctctctctaccattttcccgtaccttcccccataagtcactcccaagagcctgggcaggtctttgaggaattgcggctcattttggcagccccgtcctgcaattacctttgggtttgaaagaatagctgtgggtgggcaattgaggacacctctttagtcagggacctttctagcaatccactccctcccatcctgttagccatgcagtggaactctccttccctctctgccccaaccccggtgatggctcactctcagcatcttatgggaccatctgagttaacaaccctgttccaagaagactttgtgcagaacttttgttagggtggtcataccttctcaccaccatttggaagacacagcctaatgctgatgtacttaatgtgccccttccggcatagaaataatgtctgggtaacagccatcaaaatcactaagaatgacattggatagctatgagaaagtagtagagaattgatttaaaatatcattcttgtttggtatagattaaactaggaaatgttctctctgaagcatgaaaatgtttttcccatgtgaagtttagtacaaggatggaaaaataataatcacagtagactttgaacaatgcaactgtatctctgaatatccacatttaaaaatagccttcactgaatgctgaattgcatttcccattaatttttggttttaaaaattttgtaaactttttttttatttggaatttagtcacatccattaaattttccaatctagtttctgtggaaattttttaacagagagaaacaaatagaaacatcttcaaatcttcctaagtgaatatttaaaatgcagaattgcttatcttctgtttttctgtattcagacacttatatctgttgtatatattagtttagacactctcactaatatacacagtatttaagactctaaatgagatttcttaagtattttattttattctctgtaaatggttttgtataatctttaaacatctacactttgcctttgtagatatttaagggaaaccatttggggttgtcttgcatgtatatttttgttgtagataagtgttgcttagttatttctgcaaattttggttgaaatgcttacagactttaatacagtatatattttcaaaatataaacttttatatttctgtgataagttaggatatgcgttttaggcaatatttttcattaatatcacttgttcttttgaaaaatagcatactggtttggtgccaattttttcattagaatataatgctcttatattgttggagagcaggttaatcttttttcgaagtaattgcgtttgaagtataatttcaaaatgtattgaatttgtgaataagccttaccattaggatcagtaaatttttcaactttgcaactacataagtagtttaagatctccccgtaaattctcactgtgtggcagttgatggagtttgtgaacagagccttaagcttgttgcaaaaaaatttaaaaagggtaatacgggttgtttcctccatgcaacgtaagccatgctgatggactgaatgcagtctgtaattcatggctaatccgaagagtttgattgagttgatggcggcagggaccagatagacaccttggtgattgtctttggccataagaatagaccaaggataggttttccagagacaccttcatactgtaaacatggtttagacacggtcatagggaaggctgctggtccatcatttgttctgaacaaatggcatttcctgctcctgaccctggcagttggccccagattccttgtcgatgacttggaaacgtccattctgggtaaggtcagcactccctgagagatgttaacaaagtttacctatgagtcttactgtgtagacaatctgaagtcaattttagttacacaatcagcattcccatgtgtcctcagtgtcttatcaatgaactatgtgtatcaagccatactaaactggagtttagcaggacaaaggcaaactaaatgtagaacataacatatcagctgaatatgtctatccaggactgtttttctagaacataaatcatggagctccttgacagtgtatccactgtttttggggtttaataaaaccaactagaatttagacttaaaaagaaattattattccttttggttgtccacataaagtagtccagggctatcatatggctaaaatcaagttatttggttcatctctggtatgtatttataaagtcaacttatcagccattaagatggagatttgctttaaatttttgcagtgtgtgtggcagtcagaaaaacccatatctagttttcaacttcacctctggtgtttttatggcttaaccttatatcattgatccaacatctagcctgatgctggagctcttatttctagcctgatgctggagctcttatatctagcctgatgctggagctcttgaagctgactcttggaagtttggagggtgtagagtttcccatctagtatttaatttgtccctgtgccattagtcccagcttgaagtcatttgccagtgtcgatgttgacaggattgtgacaatattgcctttcataaaaccgagaaccaaagaattccattattctaacaaagcctgagtttcatagattgtgggcacatctagacagatatgtgcatgcttgatggtgcagagaaactgctgacttccaccaacctcatgctccccctggctggccatacagagggattcgttgtcatattgaaaaggctctgaaagatgagtttctaattgaagctcactatctcaggttggtgtttctactgtgtagtcccaagcctgtatccatatcataaaagtggaggcctggtactcctccaggttatctggccagtgtagactcctccatctgaatatgaacctccagggtaagaatttttcagacatgtctatactgaacagtaggatcctgcactttccaaatgtctgcctccttttgttcttcattgacccattctaattcctgttaggtgtgagaagaattgtcttcagttctctctccattctcattcatgatggaatcattgatccattgaccagttgagaaatgattgatgctgaagaagtggtattctattggtaaggcttattaccaaacttccgataatgaagcaggctaccaaaaacttatccagcccaccctaggagtgtttggatttgatcatggatgtagcatacaccaaaatccaccgagacctttgcaaaattaggctacttgttttattttgccagattatcatgggagagtctttaactagttctgaatatttgtaagtctgagtacttcatagaattataaagaaggtacagctgaccccttctcaccatgttgtaaatatttactgagactgggtgcagtactgagggataataatcttctgatttatcaaatcctgactgtctagagcaaattgtacactctctttgtgaatggtcctgtaacgtgtatgaacacatttctgggtgccttagaagttgtatttttcatgtgtgctaatatgcagtatttatacattgtgagaagctgctttgaataaaaaggttgaaacttc

SEQ ID NO: 3815 - DNA, 2086 bp, Homo sapiens
  ENST00000562812
cacacgcgcacaccggaccccgcgcgcacacgcacggagggcgcgagcgagcagacgcgcacaccggcgagccaagttccgcagcctggcatggcttctggggacctttacgaggttgaaaggattgtagacaagaggaagaacaagaaaggaaaatgggagtatcttatccgatggaaaggctacgggagcaccgaggacacgtgggagccggagcaccacctcttgcactgtgaggagtttattgatgaattcaatgggttgcacatgtccaaggacaagaggatcaagtcagggaagcagtccagtacctccaagctgctgcgtgacagtcgaggcccgtcggttgagaaactgtcccacagaccttcagatcctggaaagagcaaggggacctcccataaacggaagcgaattaaccctcccctggccaagccaaaaaaagggtattcaggcaagccctcttcaggaggtgacagggccaccaagacggtgtcttacaggactacccccagtggtttgcaaataatgcccctgaaaaagtctcagaacgggatggaaaatggggacgccggctctgagaaggatgagaggcactttggaaatgggtcccatcagcctggcttggatttgaatgatcatgttggagagcaagatatgggtgaatgtgacgtgaatcacgctacactggcggagaacgggctcggtggctctgctctgaccaacgggggattgaacctgcacagtccagtgaagaggaagctggaagcggagaaggactacgtctttgacaaaaggctcagatacagtgtccgccagaatgaaagcaactgtcggtttcgagacatcgttgtgcggaaggaagaagggttcacgcacatcctgctgtccagtcagacctcggataacaatgccctgacacctgagatcatgaaagaagtccggcgagcgctctgcaacgcagccacagacgacagcaaactgctgctcctcagcgcagtggggagcgtgttctgcagcggcctggattattcctacctaattggccggttgtccagcgaccggcgaaaggagagcactcggattgcagaagccatcagggactttgtgaaggcctttatccagtttaagaagcctatcgtggtggccatcaatgggccggccctgggcctgggtgcctccatcctgcccctctgtgacatcgtgtgggccagtgagaaggcctggttccagacgccctacgccaccatccgcctcacgcctgctggctgctcctcctacaccttcccccagatcctgggcgtcgcgctggccaatgagatgctgttctgtgggcggaagctcaccgcccaggaggcctgcagcagggggctggtgtcgcaggtcttctggcccaccacgttcagccaggaggtcatgctgcgggtcaaggagatggcatcctgcagtgccgtggtgttagaggagtccaaatgcctcgtgcggagcttcctgaaatcagtgctggaagacgtgaacgagaaggaatgcctcatgctcaagcagctctggagctcctccaaaggccttgactcccttttcagctacctgcaggacaaaatttatgaagtctgaggggccccagctcacgggcccccaacttccagctctgccctgtgtttcggaaaccagagcacagtgtctgccccggccaaggagtttgtcaaggtgtctctttatacgtagggttgtgtccatttcctcgtgtcctttggttgctcctccttggtttgattttgtgtaatggatggaaaacgcagcatacttggcctcccccacctccctgcccttcctggccagagagctgtccaaggctgtatcttcccagggctccgccaagcaccgctgtcctttccccacttgctgaaatgcaccatgacggtccaggaaggggaagaccactttcacattcttctgactcaggctgtgtctacacagtgcctctgacttggagacttggccatcatggctctctctggttgtatttagatcgggtgtcagaggacgaccaatcttagggaatttccagaccaatgagcaaaatgat

SEQ ID NO: 3816 - DNA, 2086 bp, Homo sapiens; identical to SEQ ID NO: 3815
  ENST00000563890

SEQ ID NO: 3817 - DNA, 2086 bp, Homo sapiens; identical to SEQ ID NO: 3815
  ENST00000566173

SEQ ID NO: 3818 - DNA, 655 bp, Homo sapiens
  ENST00000561616
gattcaagactgtttttcttacctcttcggtgcttctttcagcaatatgaagttaaaaccgggtcctgctctgctctgaccaacgggggattgaacctgcacagtccagtgaagaggaagctggaagcggagaaggactacgtctttgacaaaaggctcagatacagtgtccgccagaatgaaagcaactgtcggtttcgagacatcgttgtgcggaaggaagaagggttcacgcacatcctgctgtccagtcagacctcggataacaatgccctgacacctgagatcatgaaagaagtccggcgagcgctctgcaacgcagccacagacgacagcaaactgctgctcctcagcgcagtggggagcgtgttctgcagcggcctggattattcctacctaattggccggttgtccagcgaccggcgaaaggagagcactcggattgcagaagccatcagggactttgtgaaggcctttatccagtttaagaagcctatcgtggtggccatcaatgggccggccctgggcctgggtgcctccatcctgcccctctgtgacatcgtgtgggccagtgagaaggcctggttccagacgccctacgccaccatccgcctcacgcctgctggctgctcctcctacaccttcccccagatcc

SEQ ID NO: 3819 - DNA, 453 bp, Homo sapiens
  ENST00000567924
gaagcggagaaggactacgtctttgacaaaaggctcagatacagtgtccgccagaatgaaagcaactgtcggtttcgagacatcgttgtgcggaaggaagaagggttcacgcacatcctgctgtccagtcagacctcggataacaatgccctgacacctgagggagctgaggatggtaactagcgtgcataaaaacttgactgcagcgcgcaatttgctcatcattttacatacattatcccatttgatctttatgaccgtgtaatgataccctctcatcttatggatgaagaccatggggagagggactcactgaactgatcgtggacacagacttagccaaggggcagacccagaatccaaacatcacatcttgggcttttccagctaaactttgttgtcatcagcatgtcatatttgttggccgcagatataattcactcagttaatgta

SEQ ID NO: 3820 - DNA, 557 bp, Homo sapiens
  ENST00000562753
gagaagttctcacccttgagggtggacagaggttgaaaggattgtagacaagaggaagaacaagaaaggaaaatgggagtatcttatccgatggaaaggctacgggagcaccgaggacacgtgggagccggagcaccacctcttgcactgtgaggagtttattgatgaattcaatgggttgcacatgtccaaggacaagaggatcaagtcagggaagcagtccagtacctccaagctgctgcgtgacagtcgaggcccgtcggttgagaaactgtcccacagaccttcagatcctggaaagagcaaggggacctcccataaacggaagcgaattaaccctcccctggccaagccaaaaaaagggtattcaggcaagccctcttcaggaggtgacagggccaccaagacggtgtcttacaggactacccccagtggtttgcaaataatgcccctgaaaaagtctcagaacgggatggaaaatggggacgccggctctgagaaggatgagaggcactttggaaatgggtcccatcagcctggcttggatttgaatgatc

SEQ ID NO: 3821 - DNA, 1956 bp, Homo sapiens
  ENST00000303004
gtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagccttttgggggcagta

SEQ ID NO: 3822 - DNA, 7226 bp, Homo sapiens
  ENST00000220244
aaaagcggcctctcggctgagggccggggagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatc

SEQ ID NO: 3823 - DNA, 7357 bp, Homo sapiens
  ENST00000394685
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagagaaaagcttcattctggaggggaaggagttttgagtgccaaggatgaaattccacccatcactcggtctctgagctgcaggacacaggcaggacaacggtaggattttcatgccccgatctgcctggccttgagttgtggcagctggggaagccactgggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatc

SEQ ID NO: 3824 - DNA, 7297 bp, Homo sapiens
  ENST00000356249
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagagaaaagcttcattctggaggggaaggagttttgagtgccaaggatgaaattccacccatcactcggtctctgagctgcaggacacaggcaggacaacgggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatc

SEQ ID NO: 3825 - DNA, 648 bp, Homo sapiens
  ENST00000560027
ggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggtgagcaggcgcccacttggctgcaggaaagtggctcaacctcatcttgtccccttggcctttccaataagtctaagaacagccatgtagttaatgccaattaatgtaagacacctttctaggcattttgactctaaggctgactgtcccatacattaacgacatttttaaagctattaagctttaaaagtaaaataaacaccctattaaatata

SEQ ID NO: 3826 - DNA, 385 bp, Homo sapiens
  ENST00000495041
catcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcaggaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcagga

SEQ ID NO: 3827 - DNA, 488 bp, Homo sapiens
  ENST00000559966
aattggtttcttctcacacagttccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactt

SEQ ID NO: 3828 - DNA, 7039 bp, Homo sapiens
  ENST00000263468
gtcggttgttgtcaagatggcggctgcagggttgctgccgccccatctgctattgcccggcgaggtcgccgctgcctcagctgccatcgccgctacaggcaccagtgccgctgcgcgggagctagggctgtcgaggccaacccttccgcgcccgtgacgcggggcctgagagacggagtgtagggaggggccgagcaggaggaggaggaagccggagctgccatgagggaggttctgggggcgagcagacaggcggcgctgaagtgaaggatgctggcggggaggcccggaacccggagcgcggtcggggaactgggcactgaatcatcggacaacctcgacagagcccccctcggccctcgggagagcggcgggcatcaccgacctggctcttacctagatatgaaaatccatctggagaaaaatttagaagaagagcgccagatattactgcagcaacaaaaaatatgtcgaaatcgagcacgtaaatattttgtggagtcaaatcggagaaaaaaagcttttgaggagaaacgaaaagaacaggaagaaaaagaacaccaaattagagaacaaatacttcaacaaagaaaacagaagtttgaagaagttactgaaaaattccagcgtgcccatgttcctctttcacagcggaggaaagcagtttcccgaaaaccagttcctccattagaagaggccctcaaacaaattcaggaatccaacttaaaatcagaagtaaaccttcccttttcccgtagaccaacaataaactggagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaattttgtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagaccattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcagtgaaagactacattatatacaagaatccatttgcaaaaacccatccatcaaaaatactttacaaataataccacttctggagaagagagaagatagaaccagcagctgcagagacaagagataattccagcagaatccgtctaagaagacctttcatgtacttccctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattgaacctctttattaaacctctaacttactgataagatgtttatgaagtatggcatattttgatttttttaattgtaataaatattcttaaagttaccacatcccacaaaatggcccttggtggcagcaatagagcaaaggttacctttttgtatggtgaagggaggccttcctatggctgtacaattacatcgattcttccaaatttcatatttcatacatggcactttggcataccgaaaaaacatgaaatttttcattaaaatgccatgaatcaagccagggccgttggcttatgcctgtaatcccagcactttgcaggccgaggtagacagatggcttgagctcaggagttcgtgaccagcctgggcaaccctgtctctacaaaaaatacaaaaattaaccaggcatggtggcatgcacctgtagtcccagctacttggggtgctgaggcgggaggattacttgagcccaggaggattacttcaacctgggaggttgaggctgcagtgagctgtgtttcgccactgcacaccagcctgggtgacagtgtgagacccagcctcaaaaaaaaaaaaaaaaaagtgatgaatcaaaattagaaattaagagttttaagaaaacatgtggccttttattaataacactactaaattttggttcctccatagaattagttttgaaacacttgatgtagtgagaaatgcattaacatgttgaatgcctaccatgtaccaaattttgtgcatatattttttatttaatctgaccagccacccaaaccatgggtatttttgtctccactttagagatgagaaactgagccaaggccacatagctacctacagtgacagaatcaaaattcaaactcaggtttatctagttccaaaacccatgttctttctgccacaccatgttagtagaaatggaaactattggatgaaatgaggaaaaacaggaaaagaattcactttttaaatgaagaaattagtgaaaaaattgacctaatgaaggaaacatttgtgctttcctatatttttaattttaagaataggatttcggaaggcgacagaaaatttagttcttagacatttaaatagaaagttgtgtgcccctatagaaaatatttgagaatttcttatactatcaagaaaaaattctgtgaattaagatgtaatttataaaataacatttcaatgggggtaaacaggccagaagagtgtgccaagttgtttgtgaatcattccaagcacctcagatgaaaactcacttttattaaaaaaaaaaaagacaagggtttatattcatatacactagtatatatgtacacagcagcatcctgcatgccaaagtagcttcaccgttagtaatccctcactttaatacctcttaggaaccaaagaatgcctctacaagcaaaaagatagttgaaaatagttaagatccaaagtcagaataggccaaaaaaaaaaaaaaaaaaagcctaaatagtaagctggtgaaacaagataagatttgcattttactagaacttgcacattatgatattgtccttttatgaaactgtcatatgaccagaattcttctgtaattctgcccatgactcctccagaattttagtagatacagggtgggttcattaagagtgataaaagtgggaagacataaagagcctttgtgaattaaagtggaagagaataacactttgcatgctataaacgtgaaaactaacatttttggccagacacagtggctcatgcatgtaattctagcactttggaggccaaggcaggaggactgcttgagcccaggagtttgagaccagcctgggcaatgtagcaagaccccatctctatataaaatataaaaatgttggctgtgcacggtagcttatgcctgtaatctcagcactttgggaggccaaggcaggcagatcatgaggtcaagagatcaagaccatcctggccaacatggtgaaaccctgtctctactaaaaatacaaaaatagctgggcatggtggcacgcacctctactcccagctactaggaggctgaggcaggagaatcgtttgaacccaggaggtagaggttgcagtgagctgagattgcaccactgcaccagcctggcaacagagcaagactccgtctcacaaaaatgaataaataaaataaaaataaaaatgttactttttaaaaagtaacttttttaataatataagaaagaaaaatgccctttcacactgaatcttcaagttctaaggaagaaaagagtctcctttcgaatgtgaagaagtaaatttagaggaaatcaaacaagcatcactttcctcagtggaaaaacttatgaaacttcttataagagagagtaatctcaggccggacatgctggctcatacctgtaatcccagaactttgggaggccgaggcaggtggatcatttgagctcaggaattcaagaccagcctgggtaatatggcaagagcccaactctactaaaaatacaaaaagaaaagaaaacagccaagcttggtggtatgtgcctgtggtcccagctactggggaggctgaggtgggaggatcgtttgagcctgggaggcagaggttgcagtgatcaggaattgtgccactgcactccaacctgagtgacagagcaacactctgtcttaaaagaaaaaaaaaaaagagagagatagtaatctcttgggcaaaaggtatcaaataattgaaagaaaagtttaaacacatttccgagaggcagggcaactaataactggtcagaaaaatttagacggtcttcattttaaaattggcatcaggaaggattaccatgaacttattttaaatccatattgtaccagaatgactatgtctgtgtttcttaggaatgttgaagctttttgtgaaaactgtactgtatacatatataaatatacacacacttacatgtatgtattttgatagatattacatggactaaattttgtcaatttcatgtaatttaccctttgcaataaaaatgattcattaaatat

SEQ ID NO: 3829 - DNA, 4533 bp, Homo sapiens
  ENST00000532529
gtgcccatgttcctctttcacagcggaggaaagcagtttcccgaaaaccagttcctccattagaagaggccctcaaacaaattcaggaatccaacttaaaatcagaagtaaaccttcccttttcccgtagaccaacaataaactggagatccattcctgcctgtccagctgtctccacacctgacccctacttacctgatcaactgtctcctccacgggtcccattgcggtcccaccacttccaaattcttcctagctacccaactgtttctcctgcccgccagccccatatactgcctatccatccatctgtaccctctactcttccaaagacctttgcaccagtcccattactgccttacccaattaaatatcatccttgtcctccaaccccggctacttccagcatttctagcagtttccctcgtctaccagcaccaattccttcttgcccacctggccatccaccccacgcaccccagagttctccaatcattcctgaccctgagtcacagcacaagttattttacaaaactttcagacccaaacatttccttccagcacagcattctactgcagccactctaatgcctacccttgttcgtcgttcccttccagctccactggttgtttccccaacccctttggaacctctccctgttttgaagccttcctgtttatccagtcaccccccttatccaccagtccccactctttcttatgtcactccgttgcctgcacatcctgctagcttggatccttttcagtcagtccagcaatctgttccacaagccacagcattgtcaaatcagcccgaggcctttgcagatcatccaccagcctcagttctctcccttgcatctccctgtcattctccatcttcttctttgccttcatctccttctacttccacatccttttcttcagcctgtatactgttttcttcctcctcatctattctttcctcttcttcgacttcctgttctacttctccatccttacctccttcatctatccctcttttttcctctcctttgcattcatcttcctctccaggtttgcctccaacttatttagcttttccctctccagtttctcctgtttcttcttcctttatgatttcctcttcctttccccctattcttcactctccttctgtttctacctccccatctccttttattcctatccaccccttcaatcctcctcattgggggaagaaagtagagaagagaagagaagaaagtggagtagagaagaaaggaatagagaagaaagttgagacacgacaactttaaagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaattttgtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagaccattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcagtgaaagactacattatatacaagaatccatttgcaaaaacccatccatcaaaaatactttacaaataataccacttctggagaagagagaagatagaaccagcagctgcagagacaagagataattccagcagaatccgtctaagaagacctttcatgtacttccctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattg

SEQ ID NO: 3830 - DNA, 631 bp, Homo sapiens
  ENST00000532077
agagcagaaaagacaaaaccctggatctgtaggacagaagtacagtgagcaaattaataattttggacaaagtgtcctgctaagttcaagtgagccaaaacaaactacaaggggtacttcttatattgaagaagatatacaagaatccatttgcaaaaacccatccatcaaaaatactttacaaataataccacttctggagaagagagaagatagaaccagcagctgcagagacaagagataattccagcagaatccgtctaagaagacctttcatgtacttccctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattgaa

SEQ ID NO: 3831 - DNA, 2380 bp, Homo sapiens
  ENST00000590143
agtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttacttgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtgaatgtgcctcttaggagcacttgtccagaagtgtctgggaaaagcttgggctgcacagtgatggtgctccctgaaagactcagagcagcacagccagtacctccagagtatgaagcatgaagtacacttattctacaagaataagaagtaaatataaaaaaagtcaaggattcaatttttaataaagtaacaaaatcaacaaaacaaaatcatattcagagtaacatggacttcacagcactttgaaaaagacatttaaatgttgatttgagttgttcagacattttaaatatgaagtcatagagtaaaaatacaatcaatgactgaaattggg

SEQ ID NO: 3832 - DNA, 2939 bp, Homo sapiens
  ENST00000262127
gtttgtccgccactgtttgaaaacagttggcgccgccgccgccggggcctcatttccaggtcagcccccggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattaccacttttgtggtttattcgtggtccttgggatatttgagactgtccagaaatttatggttggaccttgaagcaagagtaggaaaaaactaataccagaaaagcataaatattaataacctcatatgaaagtacatgaatcatttagaaatatttatcactgtgatttgttgtaaaaatgaattgggtattttagaaaaactttattatacctctttgttatgatactgataaattgtgatcttgcagtcga

SEQ ID NO: 3833 - DNA, 2197 bp, Homo sapiens
  ENST00000423709
tttccaggtcagcccccggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaagtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagtt

SEQ ID NO: 3834 - DNA, 817 bp, Homo sapiens
  ENST00000589490
tcctcccagtgcacaggctggttggagtttctctggggacccctttccacctggctgtctcacttctttcttcatggaacattctctttccttagcttcttttttatcattgtctttcaatatttattattcctctctggctgttcttagtttttccttcatcttgtctttaaatgtgtgtgttctagaggcccagccctgggccctcttttcattcccgagtcctctttctccctggttgataatcatgcctaataatgttttggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcg

SEQ ID NO: 3835 - DNA, 534 bp, Homo sapiens
  ENST00000587666
aatataaaacttgaaatgtatccaccactcaatcaaacgttatctcaagaagtagtgaacacacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctggga

SEQ ID NO: 3836 - DNA, 3309 bp, Homo sapiens
  ENST00000593250
ggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttacttgttgagcaagaactcccttcctctccaaaacaacctatttgttttgatagacaatcgacattaaaaaaaagttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagatagagtctcactctatcgcccagggtggagcacggtggcatgaactcggctcactgcaacctctgcctcccgggttcaagcaattctcctgcctcagcctcccgagtagctgggattacaggcatgtaccaccatccccagctacttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaaggtattatacacacataatagaattaagtagcagtatatcatagttactctgaatttgtaatccatttgtaaaagaatgccttagaaaaatgcacatatagtcaaccctctgtacccacaggttctgtatctgtagattcaaccaactgcagatcaaaaatacttacaaaagtaaaaaattacaataataaaaaatagtacaaattaaaaaatggtgtgtaacaacgtttatgtagcatttacattgtattgagatttttaaacaatttagaggtgatttaaagtatataggaggatgtgcttaggttatatataaaatactataccattttggctggccgcagtggctcatgcctgtatcccagcattttgggaggctgaggcaggtggatcacctgaggtcaggagttcaagaccagtctgggcaacatggtgaaaccctatctctactaaaatacaaaaaattatctgggcatggtgtcgtgtgcctgtaatcccagctactcaggaggctgaggcaggagaatcacttggaccctggaggcggaggttgcagtgagctgagatcgcaccattgcactctagcctgaggacagagcaagacacgtctcaaaaaaaaaaaaaatactattttatataagccttgagtatccacggattttgttttgcaagggtcctggaactaaccgctttggggtgctatcagcttgaccacgtcagaaccttgttctgtttttcataacatttaaatatcaatacacaaaaaactcagcatctttattttctcatgtagtttcttatttattgtgatttctgtgatgtagggacctacaagtactaaaatgtcagaaatcaagttgcagaatgaattaggaacagcaccaggaccagaccatggctttctggtactactgatgtgttgcaatttgctcagataatacatctttaaaaaagagaaaataaggctgggcgtggtggctcatgcctgtaatcccagcactttgggaggcagaggtgggtggatcacctgaggtcaggagttcaagaccagtctgaccaacgtggagaaactccgtctccactaaaagtacaaaattagcgtggtgtggtggcacgtgcctgtaatcttagctactgaggaggctgaggcaggagaattgcttgaacctgggaggcggaggttgtggtgagctgagatcgcgccattgcactccagcctgggcaacgagcgaaactccataaaaaaaaaagagaaaatggcagtacaaaattaatatagaaaaaatattaaaatagaaaaaaatcttgaattgcatgctatttagtttgtttagtttgtatttaaatacaaatgtatatttaattacactttttgaatgacttgattttagtaaactaattttatagattatgggatatttcctaatctgtgttctaaaaatgttgatagtatgataacaaacaagtaaaactatctttaggccaggcgcggtggctcacgcctgtaatcccagcactttgggaggccggggagggtggatcacctgtggtcgggagttctagaacagcctggctaacatggagaaactccatctctactgaaaaaatacaaaaattagccagccatggtggcgggctcctgtaatcccagctacttgggaggctgaggcaggagaatcacttgaacctgggaggtggaggttgcagtgagccgagatcacgccatcgcactccagtgtgggcaataagagcaaaactccatctcaaaaaaaaaaaacaaaaaactatctttagcctgggtgacagagcgagactctgtctcaaaaaaaataaataaaggtgacagcaggccaggcatggtggctcatgcccgcaattccagcacttgggtaggccaaggtgggcaaatcacttgagcccagaagttccagacaaacctgggcaacatggcaaaatccctctctcta

SEQ ID NO: 3837 - DNA, 413 bp, Homo sapiens
  ENST00000591034
aatggcgatcggttttgggctcagaaaatggagtgaccagtctgactgtggaacttatgggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggtttgtaaattatattagaataattttatgcctgtatttgagatttactgttatgtgtgtaaatttcatttaatatttatttgtaaaatgtattccaaaaaataaaagtgtatttgtaaaataaaa

SEQ ID NO: 3838 - DNA, 684 bp, Homo sapiens
  ENST00000585751
gagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggtttgtaaattatattagaataattttatgcctgtatttgagatttactgttatgtgtgtaaatttcatttaatatttatttgtaaaatgtattccaaaaaataaaagtgtatttgtaaaataaaa

SEQ ID NO: 3839 - DNA, 831 bp, Homo sapiens
  ENST00000592660
taatacaatagggaataagtattttaatacagcacctttttttggtttttgaagtttatgaacccgtttgttataaaaattgacctaataacagcttctactctgtgatgacactttattaaaatcagctcatagtggaattataagccaactgttacataaggtttacagaaagtttaaccttgttgaaggacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatg

SEQ ID NO: 3840 - DNA, 550 bp, Homo sapiens
  ENST00000589875
aatacaatagggaataagtattttaatacagcacctttttttggtttttgaagtttatgaacccgtttgttataaaaattgacctaataacagcttctactctgtgatgacactttattaaaatcagctcatagtggaattataagccaactgttacataaggtttacagaaagtttaaccttgttgaaggacagtgttgagcaagaactcccttcctctccaaaacaacctatttgttttgatagacaatcgacattaaaaaaaagttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgac

SEQ ID NO: 3841 - DNA, 787 bp, Homo sapiens
  ENST00000587929
gaaaacagttggcgccgccgccgccggggcctcatttccaggtcagcccccggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaagttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgac

SEQ ID NO: 3842 - DNA, 897 bp, Homo sapiens
  ENST00000586887
cctgtttgtccgccactgtttgaaaacagttggcgccgccgccgccggggcctcatttccaggtcagcccccggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaagttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtaagaaacagtaataaattgtcatttaattgagtaaatctttgttatgttttattgtgaaacaataataatgactttttctgtaaggagagatttataatggaggaatctctattttgtttcccactgctcttttcaatttaaactactatccaccttcttgcaatattctgtttgctattcatt

SEQ ID NO: 3843 - DNA, 1957 bp, Homo sapiens
  ENST00000498239
cgaagcactaggccgtttgaggatctccgctccgctttgcctgggaccaggaaaagacgcgagagacggaactcggcatcaggcactgcttggggcaggaggagagtaggggaaaccaaggaagagaacagaaaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttgg

SEQ ID NO: 3844 - DNA, 2110 bp, Homo sapiens
  ENST00000480324
gctccgctttgcctgggaccaggaaaagacgcgagagacggaactcggcatcaggcactgcttggggcaggaggagagtaggggaaaccaaggaagagaacagaaaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacaggtattgttgatttttttaatgttattgattattaacaatggttaaaccagtgtgctaagcagtgttagaatacatgtttagtcatgagaataagtaattttgtattaaattttagtatttctcaaaagactatgaacctagttaatatttgttcattattggtagtgttaggaaatttagaaattactttctgcttgttatttttagccccaaatattgttttggcatcttttgtttttaaaagcttggggcataattgtcaccatcaaaactcttatgaactaaatgagagtacagtggtgggagactagttaggtaatttgtggtcttcatatatttaaatgaatgttatgtagacattcagaattatgttaatggacttggattataactacgtcataagaagctcagagaaagactatgacaaattaggagtatcgttaatattgcattgtgtactggaaatttgctaagagagtacattttagatgcttttaccacaggagaaaaaaggtaactatgggacatgatggataggttaatttgcttaactatagtaatcatttatatatatggcatgttttacacctcatatacaatttttaaaagaaacactaaagtgctagcaataactgagttactctgtttggattataagtgatatctctttatttgcactgttttgcaagtttttaaaatagtagtttattatgtttttagagaggaaaaagacacttaaaatctaaatgacagtttttcagctagtctttctgacaggaactcatccctcccctcttttatttttgttttatttagtttctcaattattttcttgtttgacatggcacttaaaatatttaaaaagaaactaacaaaaaccccttatagttttacctcctgaatccacatttacaggtataggtgcatatcaaaatcattgcttcattgtatcccaacagcagcttatttagtagaggaggagaagcaactaaggtcatataattttttaagagtcaaatcaagaaatactcaaaacttctgttgaataaatggtagttggctgtcttgaaaggcaacaaccagctgactgcaggatggcaggatggcaggcttcctattatttattttaaattgcagtcatttttgcgttgtagtttgaggtctagacttttataggaagtctttttctatgtatgtcacccataacaatatctgtttaaaaaaaaaaagacagttatcaatctgaagcaagtaagtcggtccgtctggggattatatagcccctttgtttttcttttttggctgtctgccttgtaatgatttgctgatcattagtactagtgtctctaagtcaggaaaatactcgaagaaatgttgaagtattttagttgccttcaagaactttgcttccactaagtgatttggtaaaaaaaaaaaaaaaaa

SEQ ID NO: 3845 - DNA, 783 bp, Homo sapiens
  ENST00000476865
aggggaaaccaaggaagagaacagaaaggtagggcacggggagctgagcccagctgcactcatccccgcccccggaaacccccgcagctcccgccccaaccagcccccctctggcgcctggcataaggtagcccccggaggcaatgagggccagcaggagtctcgcgcgcctgcgacgcgggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctgggga

SEQ ID NO: 3846 - DNA, 2198 bp, Homo sapiens
  ENST00000357172
gtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactg

SEQ ID NO: 3847 - DNA, 851 bp, Homo sapiens
  ENST00000460443
tggagacattggggtggcggagcgccggcgcgggagccggggggctgttgtgtgggagcccaaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatg

SEQ ID NO: 3848 - DNA, 2175 bp, Homo sapiens
  ENST00000478042
ggagctgggatcatgtcagcctcattcactgcatttatatgttggctgaatgcattggaaactgcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactg

SEQ ID NO: 3849 - DNA, 764 bp, Homo sapiens
  ENST00000473474
gttctaagatgtctaccctcctccacccaagacagaatcgatcatctttgacacctacctgcttagtctcctgaatctgctactgagtgtaattccccttattggcaacaccactcaccagaattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatatagga

SEQ ID NO: 3850 - DNA, 5300 bp, Homo sapiens
  ENST00000467362
ggaaattgccttccaaatcctcattaagttagaaggcttttactgacatttagaaagcaagtttatggtcagaacaaataaaaacagtgcagatgtcttcataaggctgattccagaagatcagctgttttgtaaaggtaagtgatttgcatctattacatatggattacccattctttcccaaattttttccccaaagagatgaatttttaccaaagattatagttattgttgttgttgtggttttccttttttttttttccaaaggaaagcagttgtcttcatgcataaaagtcagtgcttgttttatacattgcaagaaacaaaaagcatattttttgtttgttgcttccccaaaagacattccttttagaatgccttggaactatgttctatcatatcactctttaaaaaaaacaaagaagaatatattcttatttggaagagacttaatataatcaactcatggttacttttactgatgcttgagtcttttaaatgtagtaattgatcaaattgtattaagccataagggactttctggaattcagttaaggcaactaggtgagtgttactactgcaggtgaggtttcaggattcatttggtcagactgaagacgttctatgtagtataaattgattatatctcattcttgaactacaagactttaaaatgcctttacacttaaataattctgatagggtgattttcctttgtagacactgtaattatgttaacatttgctgtattttggtggaattcatttacattaaaatgatttacaaacaggcattcccacattctttggaggaaagtgtctaatctcaaaatggtactttttatttctgctctgatgtacaaagcctgtaaggacattttatcatgcttataagaaaactagtcaaaatttactaactgatattagtctgcattaatacaaactattgaaccaaaaaacatgacctttgtaatctggtaaagatactgataatttaagattttctttttctatgtctaacctttttaaaagtgaatttcattacattgttattatttggatgcataccttcatggtatgagtctggagagttttcacctggctgtaggacagacaccatggtccaaaggaattcttactcttcccaactcttaaagacttgaaacttcaagcagacctgacataaagatgtctttggtatagctctttggctatttctaaagagtggatgcactttggccacctttgataagttccaagatgatgacagaaagaaaaagattgggaaagacagaatgtgcctgttctttttgacttgagggagagagagaatgtgccaccctccttgatcttaagcgtggggtgagaatggcaacactttgtgttttttataagtagtgccaatttttaaaggatcacctggtgagacttgggattcctttgactcgagcttttccttcactttgcctcatattttcttggtagctcactttctttttcattgctaatgtgggggctagatgtttcttcatactctcccaaaacaggagttctacatagaaaggaagagaaagggagattttaatcttcatttaacaaatgtgtattgagccacctacaataaccagggctctagagagtgtacaaaatcaattcaaacaaaatccaacactcaggagcttatgttttggtgtatatagctaacatatatgacaaaagtgatgaaaaccttaagaatctatgatactttgcgcctaggtcaatagcttgcttccttactttgtggtccaagccatgtactaattttcctggcttttctaatgtttgtgtttattcttctttcaaagggcaacaatttttatgatcccaaagcaatttcaccaaattttaaatacagttatgactctcattcagttcatttatgacacagatgactattatacagagatggtactcatttagtaccctggccctaatacagggctgtccctgtaatagaataatgctttgcttcttttggaatctgagggaagtatagtattttcccttttgccagagagatcttttgtctctatggagtcaaaagtgggaggggtgggaagagaggttgggaaccaggaaactagccacagtattgagtttcagccaggtgcatcagattgagaatgtaatgtccctagtttattgaacaagagcagaaaaatctcttggagttcaaagcaaccatggtgttgattttctcctttcttgaaaacaagttttgaacttagactgtagaggttggagatttagggggagaagataaccatttaggataatccataaagtttaggacttgacttagttgacctagttaattttagaactaggttgacctagttaattttagaaaatttaacactgctacagtacaatttaaacttgaacatttgatttcaattttttttagagctgcatttttgcaagaggtaacagagttatctcaacaaagtgagttcttgagagttttgaagaaataaagtatccaaccattaagatttatgtcttccagtcttaactgaggttttctatatagtaggaagtgccacatttgctatttgattttaaaagtgtagatagatgttagccatacaaagtgtaaacagccctaattaaaatgctttcattgtgaccgggcatggtggctcacacctgtaatcccagcactttgggaggctgaggctggcagatcacttgacgtcaagagttcgagaccagcccggccaacatggtgaaaccccatctctactaaaaatacaaaaattagctgggcgcagtggcacatgcctgtaatcccagctactcaaaaggctgaggcagtagaatcacttcaacccgggaagcgggggttgcagtaaaccaggatcacaccgctgtactccagcctgggtgacagagcaagactctgtctcaattaaaaaaaaaattttttttttcattgtaagaactcatggcttattaaaccactgggggcttttggaatcttgtttctataatcatttgtttctattactagactacgtcatttattttactgttgctttcttttcaatccatattggacaaaatttgagaccaaaatttaaagggaggggtgcgaaaaagaagagactcttaaatgatttttaaaattcagtacaagtgtatttcattttaaatgatagatattgtgtttgcaaaaatgcatgacatcaatccactctgtcccccatacttcaggtaaataaacacattttcagtatactttatgaatatattattcacttttctgaaaagtacatttaaacttcaaaattttgtatgcacaatagtagaatctgtttgaatgtacttgacctgttttttcttctgcattgtgaatgccttcttaattgccttctgcttttactagctgcctgtatcctaacaatttggagttgggaactcttctgaatagaaattttatcttccattctctatactctgcagatttttatatctagtcgcaacatttctattatgattcatacttcctcacaacaattatgaatgttctacagatttagaggtagaattcaaaaacatatacaaggaaaaaggcagggtgcactccttttattaaaaggccagaacacatcctggttcactgttgcaagaccactgggatgcattaggtgaatctaacttagcttgtgacacaagttaataaagttgaatctggtttttttgttttttttaaggttgatggctgaagtgagattaatttctaaatagtctcaactcttgagacttgctatattgcttataatgaagaggaaaaggacactttcattactttacgtatttatgtaattggagggaatggaaagtttttgggaatatgaatcaaatattagactgttttcttattttagtttgtatatgttttaattgttttctctctctacccattaaagattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccac

SEQ ID NO: 3851 - DNA, 511 bp, Homo sapiens
  ENST00000483427
cttattcacatgttttttaaagtatgagctgctttgtaaaaataagcctggtctcttaagtgaaatcctcagtttgtgcctaatgaatttatgctgctacttttcattagctcttctagtttgtgatttatagaaattgctgcctatcaggcaccatgaggttcctgaaagtttgagttgaactgtgaactgttctgcagcagatccatgtagtatctgatgagtactgaatactattaactcttctcttcactctgtacagggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagc

SEQ ID NO: 3852 - DNA, 2251 bp, Homo sapiens
  ENST00000545121
cgaagcactaggccgtttgaggatctccgctccgctttgcctgggaccaggaaaagacgcgagagacggaactcggcatcaggcactgcttggggcaggaggagagtaggggaaaccaaggaagagaacagaaaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactg

SEQ ID NO: 3853 - DNA, 1966 bp, Homo sapiens
  ENST00000615636
aaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagcc

SEQ ID NO: 3854 - DNA, 551 bp, Homo sapiens
  ENST00000420034
aagtctaagcagaatgggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctg

SEQ ID NO: 3855 - DNA, 5201 bp, Homo sapiens
  ENST00000372842
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 3856 - DNA, 530 bp, Homo sapiens
  ENST00000447915
aagggagaagaaatctggcatctctccagaatgcttctcattgcagggccgctggcctagaaatggcctcaaatggaagctgccacccgatcctggtggaggctttgagctaggctagagatcaggactccagggttcagtgcgcacgtgctgcccctgcactaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagg

SEQ ID NO: 3857 - DNA, 887 bp, Homo sapiens
  ENST00000420512
ggaaagggacctgtctgaggttggtgacagacacccagttcgatcccatctgtggtgccgccaggccgctcccttttctgctcctctcccgagaggctgcagagttctttccctcccagcagggtcctaaggaccccggcggtgctccaggggagccaacatcccctgctttggaggacggacgggtcgggtcgcagtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactaggt

SEQ ID NO: 3858 - DNA, 2685 bp, Homo sapiens
  ENST00000372838
ccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaa

SEQ ID NO: 3859 - DNA, 901 bp, Homo sapiens
  ENST00000493788
cggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctgacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcaca

SEQ ID NO: 3860 - DNA, 1176 bp, Homo sapiens
  ENST00000411852
cggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctgacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcgg

SEQ ID NO: 3861 - DNA, 481 bp, Homo sapiens
  ENST00000483737
agtggctggcggctgtgggcgatgactatgctgctgtggtctggaggcctgagggcgagcccaggtggtgatctgaggggaagggtgctggggaagatggagaacagctgcagcccagagaggaaaagggacagcccagagccacagcctccaagccagggctctgtccactgccctgcagagagggaggggcatgtaccccatgggaacatctcacctctatcccctcaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccc

SEQ ID NO: 3862 - DNA, 1205 bp, Homo sapiens
  ENST00000463535
atcctaggagccacgctgggtctctggcaggaccactcagtgaactccttggggggctgcagcccaggcagggctggagcctgtgacgtcccctcctcaaagtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagca

SEQ ID NO: 3863 - DNA, 587 bp, Homo sapiens
  ENST00000483893
agtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctgctactcaggaggctgaggcaggagaattgctcaaacctgggagacagaggttgtaatgagccaagatcgcaccattgcactccagcctcggtgacagagcaggactccatctcaaaaaaaaaaaaaaggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagg

SEQ ID NO: 3864 - DNA, 553 bp, Homo sapiens
  ENST00000487001
tgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagagcgagcagtacaaggcacacttctggccacgggacctggtggccttctccgcccagcccctgctcgctgcccctacccactatgccggggacgccgagtggctc

SEQ ID NO: 3865 - DNA, 338 bp, Homo sapiens
  ENST00000472858
gtggctcatgcctgtaatcccagcactttgggaggctgaggtgggtggatcacctgaggtcaggagttcgagaccagcctggccaacatggtgaaaccccatctctactaaaaaaaaaaaaaaaacattagctgggcacctgtaatctcagctacttgtgaggctgaggcaggaaaatcacttgaacctgggaggtagagggcgaggtgggctgcttcctcagccattactccatctgggaagaggtggttgccaggggcctggcccgggtcctggtgtttgaggatgacgtgcgctttgagagcaacttcagggggcggctggagcggctgatggag

SEQ ID NO: 3866 - DNA, 1429 bp, Homo sapiens
  ENST00000613052
gtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttgtttcaagctgggcagaccccaggatcccttccctccctaaggactcagctgaggggcccctctgccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcacttt

SEQ ID NO: 3867 - DNA, 1554 bp, Homo sapiens
  ENST00000612334
atgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatgctgggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctag

SEQ ID NO: 3868 - DNA, 3208 bp, Homo sapiens
  ENST00000410087
gcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttcatg

SEQ ID NO: 3869 - DNA, 2425 bp, Homo sapiens
  ENST00000409440
gcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcagtaatggaatatgaagggcacgctctgtcactgcttaaggaatgtgaactccagggatttgatggtgggcatcggaaaccattgttcgcaatacattggagtgtacagagattgttcactggcatgcaaacgttagaaccaagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactat

SEQ ID NO: 3870 - DNA, 1330 bp, Homo sapiens
  ENST00000374969
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaa

SEQ ID NO: 3871 - DNA, 1403 bp, Homo sapiens
  ENST00000452174
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 3872 - DNA, 1677 bp, Homo sapiens
  ENST00000339098
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgggcatcggaaaccattgttcgcaatacattggagtgtacagagattgttcactggcatgcaaacgttagaaccaagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 3873 - DNA, 1392 bp, Homo sapiens
  ENST00000374970
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaagatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 3874 - DNA, 1535 bp, Homo sapiens
  ENST00000374967
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaatgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 3875 - DNA, 2391 bp, Homo sapiens
  ENST00000494398
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 3876 - DNA, 1395 bp, Homo sapiens
  ENST00000421817
ccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaagactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 3877 - DNA, 1335 bp, Homo sapiens
  ENST00000479558
ggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacct

SEQ ID NO: 3878 - DNA, 550 bp, Homo sapiens
  ENST00000466715
tgtattgctttgtctcccaggcccaagtgcagaggcacgatcttggcttactgcaatctctgcctcctgggctcaagcaatcctctcacctcagcctcccaagtagctgggactacaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaatgttgtctgtgttggtggagatggatctgctagcgaagtagcccatgctttgcttct

SEQ ID NO: 3879 - DNA, 596 bp, Homo sapiens
  ENST00000460319
attataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatgg

SEQ ID NO: 3880 - DNA, 572 bp, Homo sapiens
  ENST00000476070
gttgctgtggcagcgctggacgcggctagagctggggctgccgcgccctccacctccttctccaaaggcctccccggacccctggctcgggcccagcctgcgactccgccatgccctggaggaggcgcaggaaccgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttg

SEQ ID NO: 3881 - DNA, 596 bp, Homo sapiens
  ENST00000497337
gcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtt

SEQ ID NO: 3882 - DNA, 531 bp, Homo sapiens
  ENST00000561008
attatctttcttttccaggtgtgcaaacaagctcttggagggaaggagaggagaaaataaacaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggc

SEQ ID NO: 3883 - DNA, 713 bp, Homo sapiens
  ENST00000558268
ccacggccccgccccgggctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccagcctcaaatgggtctgccttccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcaga

SEQ ID NO: 3884 - DNA, 1803 bp, Homo sapiens
  ENST00000558331
gccccgggctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 3885 - DNA, 768 bp, Homo sapiens
  ENST00000561053
cccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggcca

SEQ ID NO: 3886 - DNA, 420 bp, Homo sapiens
  ENST00000559490
ttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagcatgtcacgtgctcccgcctgagcctctggccgcaggaatcaggtgaccccaggcagcgggccaggctgcaggggcgggatctgctccgtcacccaggctggagtgca

SEQ ID NO: 3887 - DNA, 1797 bp, Homo sapiens
  ENST00000251363
ggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 3888 - DNA, 1637 bp, Homo sapiens
  ENST00000559450
gccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 3889 - DNA, 1515 bp, Homo sapiens
  ENST00000559336
ggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 3890 - DNA, 440 bp, Homo sapiens
  ENST00000600912
agagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagggagaaggtgatggggacaaggatgaggcttgaaggagcagctagacatctggaggaagagtgctccgggcagaaggcccagcaggtgcaaaggccctgaggctggaacaggcatggtgtgttggaggaatgcaatgaggctggggtggctggagcaaactaag

SEQ ID NO: 3891 - DNA, 1826 bp, Homo sapiens
  ENST00000595722
ggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagggagaaggtgatggggacaaggatgaggcttgaaggagcagctagacatctggaggaagagtgctccgggcagaaggcccagcaggtgcaaaggccctgaggctggaacaggcatggatctgctccgtcacccaggctggagtgcagtggtgtgatcacagctcactgcagcctcaaactcctgggctcaaccagtcctctcacctcagcctcctgagtagccgggattacagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 3892 - DNA, 873 bp, Homo sapiens
  ENST00000558501
gctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggtgggcccgacccctgcctgacccttcccagctgctgtacccagccctcccaggtgccccagagatgaggtcccattcctccca

SEQ ID NO: 3893 - DNA, 568 bp, Homo sapiens
  ENST00000560412
actgtccccctcggggcttcccatcatggccgtctccccgagctatccgcgctcccccacgagggccggggcgcaacgggtgcccgaggacgcggctgtgaaacgggctggagcgagtaggggcgatcctggcctcgtgacgcgggggaatccggatgtgtgagccgggggagcgccccgtttccccgacgtgccagggctggggacgcagctggggccctggcctcggagtccgcagcccggccgcgtagacggcttctgagaaccgcttaaacacgtcattccaagcccgagctaacccatcaggcggccggggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgt

SEQ ID NO: 3894 - DNA, 758 bp, Homo sapiens
  ENST00000558877
gtgacctgggagcagcagaaatctggaaactgacagcatggacgtgctggccgcagcttccaggatctgctccgtcacccaggctggagtgcagtggtgtgatcacagctcactgcagcctcaaactcctgggctcaaccagtcctctcacctcagcctcctgagtagccgggattacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcac

SEQ ID NO: 3895 - DNA, 2401 bp, Homo sapiens
  ENST00000557925
ggctcactgcaacctccgcctcccaggttcaagtgattctcctgcctcagactcctgagtagctgggattacaggcatgtgccaccacgcccagctcatttttgtatttttagtagagacagggtttcaccatgttggtcaggctgctcttgaactcctggcctcgtgatccacccaccttggccttctaaagtgctgggattacaggcgtgagcaactgcgcccggcctactactctgttttacagatgaacttgaggttcagagaggtcaagtcatttgcctgaggacacacagcccaactctgccttttaacactgaccaggcaatggagtgggagtgatgagaatgaagtggtggctcttctgggaccagaggacagttccaaagtcccaggcaaggggagttccatcttccagtcctgcctcctggttgtcaactgcgctgataggggcccgagtaggagttctgaggctccagcctctcaggccccacttgccccacccattctgcttgcagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgtgagtataccagagtatagctgactgctcacctgccccatccacctggcctagatctggcaggagtgggggtgtggagtggtgcagccagagaggaaaacatgcagctgaggagagagcgagctttgcaagatggtggtgaatgttcactcaacaggtatttggatttactatgcaccaaaagttggggttctgcagtgaatgagccccccagtcgagagtgagaagcaggaaaaagcagggctgggtgaaggtagcatctatgtgactgtggaaggagaaccaaagagaccgcagacccagggtgggaggttggattctcacctctgcacagcctgacacccatttccctgcaggagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcc

SEQ ID NO: 3896 - DNA, 429 bp, Homo sapiens
  ENST00000558302
tgagaagaggatgtggtgggagctgggctccaggacagtgtcccaggcaacaagcaaggaggagttcgagggaaggagcagtgctggggaacattctttccaactggcttgggttgcacagtgaaaatgaagccccgcccctcccagcctccgtgggagacaaagccccacctctgtccggctacccgggagatgaggccccaccccttttttactccttgggagatgaggccccgcccctcttaaactctgggagatggagccctgctccctgtgtcttcctgggagatgaggccccaccgcctgccttcctgacatgaagcccctcccctatgaggatcctctacaccacatactacgagtccatcagcaacaggggccccttcttcggctactacttcttcaacgggcttctgatgttgctgcagc

SEQ ID NO: 3897 - DNA, 710 bp, Homo sapiens
  ENST00000599275
taggactgggggctacagcggctggtcaaaccccagcctcctcctctccccctggctgtaggatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 3898 - DNA, 574 bp, Homo sapiens
  ENST00000560091
gcattttcacctgggactgttccctgggctgccttgtggtttgcatcaactggaagaggctttaaggagaccatctctgagtttccagtgtgggcacaggtgggcttatctaaatcagatcccaaatagtatttaaaaagcctctaccaaaagaagaggaggggctcaacctgagagaaaactcaccagggcagaaaagatgacagccatggaagcagagctcaaaggactgaagagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgcca

SEQ ID NO: 3899 - DNA, 572 bp, Homo sapiens
  ENST00000561216
attcatgtgtcaatgaagaattcctgccagacttccagtactgtcctcgaccatgggcagaatcccagctgcccctcccagaacactccatgccactggaactcaggagcgcaggtgggcttatctaaatcagatcccaaatagtatttaaaaagcctctaccaaaagaagaggaggggctcaacctgagagaaaactcaccagggcagaaaagatgacagccatggaagcagagctcaaaggactgaagagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgag

SEQ ID NO: 3900 - DNA, 1631 bp, Homo sapiens
  ENST00000286732
gcctggggccgggtcgtcatggcgacgcgccacgctaacgcatggtgtcggagggaggcccacttgctgaacagcagggagcgatggcgcagaacgtgtatggtccgggagtccggataggcaactggaatgaggatgtctacctggaggaggagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgccactggtcaagtccttagatatgggcaggacttttgcctggggataacaggaggatttgacaacaaaatgttgtatttgtcaagtgaccacaggaccctcctgaaatcgtctaagaggtcttggctccaggaagtgtacctaacagatgaggtctcccatgtgaactgctggcaggctgccttccctgacccccagttacgcctggaatatgaaggcttccccgtcccggcaaatgctaaaattctcatcaatcactgtcacacaaatcggggactggcagcccaccggcatcttttcttaagcacctattttggaaaggaggctgaggttgtagctcacacatacctggattcacatagagttgagaaaccaaggaaccactggatgttggttactgggaatcccagggatgcctcgtcctccatgttggatctgcccaaaccacccacagaggacactcgagccatggagcaggccatgggccttgacacgcagtaacacgccaggcacgtgcatgttttccctggtcccgctctcatcaaatgtagctttaaaagaaattaacaaccttggtcatgcctcaagctatttttgaatcagatgtgggactctctgggcactatattaaaataaagattacattaagattattgaatttgtggtgggagtctagggctgaagaaaaacagctctggagaataattagtatttgaaagtgacaaacaatagccttttgttgataaacaaattctgaagaactcagcttcctctacttatatccttcattgtctacaaggacagtgcgttactttttaaagttatgtctatgtaataaagctgttggacctatactgaatttttggtaccacagtttccctcttgaatgtactaaaacacaaaaaactgacagctctgagctgtggccttaccttggaattaaacatttccacctttgtaaaacatcctatttttgtttctacctttggctttccaggtcaggacctctacctgatcagtaacctattattttgtaatgatttttaagctgcagaatctctaccttgtctttgaaactggcacattagttgtggcacccatgtgattagatagttcctgacaaaataaatgtatgtccttcca

SEQ ID NO: 3901 - DNA, 1354 bp, Homo sapiens
  ENST00000262498
gcgctcccggggggcgggctcagatgggcggagggattcattttaagcaacgggcggccctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaatttg

SEQ ID NO: 3902 - DNA, 1605 bp, Homo sapiens
  ENST00000562622
gggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcaggtactgctcctttcccagatagagccctgggttggggatagggcacactgcgtctaatattggcttgtggcccacatagcagaacagtgtgggtttctggcttcagttgccacactgtccagggagctttggcctcacaaaggtccaggaaatattcagaagtcgggtcaggtatagaggtgaatacagcaagtaagacctccctcttgccagaatccatccctaagacaagccaaggagatgccggagatgacgcgtttccagtcctggaagagggcctctagaagattcaggaaaagggggagaacagtcacatttcgcctctcaaaagaagcattgccttgacagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatat

SEQ ID NO: 3903 - DNA, 481 bp, Homo sapiens
  ENST00000564150
gtctcagccttgggaaagcaagctgtgggaattcaggtccttgtctggacaaggttgtgtgcttcttccaagacagagctagtgtgatgcttcttctctgtatttcacaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtg

SEQ ID NO: 3904 - DNA, 276 bp, Homo sapiens
  ENST00000562443
atgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagaatccatccctaagacaagccaaggagatgccggagatgacgcgtttccagtcctggaagagggcctctagaagattcaggaaaagggggagaa

SEQ ID NO: 3905 - DNA, 572 bp, Homo sapiens
  ENST00000565880
gcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcagatgacaagaatgtgcgtcgtcgctttcgggcaagtaactaccagagcacc

SEQ ID NO: 3906 - DNA, 710 bp, Homo sapiens
  ENST00000567092
cgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtaagtatgtgtacatgaatgtgtccactcttggctataccaaagtgatagcctttgaactgatgggaaaaagtgaccctacaaagtatctttatccttttgcatgtattcttttctgcttctagtataagcccagtgcagtccttgttatgtaaatttgatattagtaataaaatttaatcaggtttttaaagaaacagcacctagaaaacctagtaatttcaaagtgtcagagttagcgtggtatcc

SEQ ID NO: 3907 - DNA, 731 bp, Homo sapiens
  ENST00000567660
aaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaaggtaggttgccacctctgttctcccagagacatcatatactagggaggcagtacgtcatagaggttaatagcacagactgcggagtcagagtgccggatgtgagtctatctctgccacttagagcttaccatgggcaagttactgaatcccccagaccttagcatactcatctgtacaatgggcagaataatagtacattttccttatagggttattgcgaggagtaaataaatgaatatatataaaacacgtaaagccttgcttagcacatagtaagcacgatgtcagtattagctatattattaaccaaagtg

SEQ ID NO: 3908 - DNA, 2985 bp, Homo sapiens
  ENST00000295220
gtccgcgtcgtcatggcgacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttacccagcctaagtcaactgtaggatattagtgtggcctgctgaacccaaatcctgcaaataaccatcattgaaatcactcgggcaacaaacaagtagaactgaacacaaattttaaaactgctgatttttctggtggcaaataagcagattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttccgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatga

SEQ ID NO: 3909 - DNA, 689 bp, Homo sapiens
  ENST00000463985
gacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgttcactgaaaaagctcattggcacgatgtcccctggaattgtcttagacattatttggttgaaatatccctgcccgcaccatcactatgtctgctgactgccttctctgccatccaccacgtggatcacagctcactgctgcctcaaactcctgggctcaagtgatcctcccacctccgcctcccaagtagctgggactacagcatctggtcaatgtttccaatgaagacacacgtgttcatattttacccccgcaaaccaaatactttgagatcaattatgtaagaaaggaacaccacctggtccctggcttgtccctcacggtcaccgttacattttc

SEQ ID NO: 3910 - DNA, 2167 bp, Homo sapiens
  ENST00000413057
gacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaacatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttaccattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttgtaagtgacaactggcagaagccttgttttctgtgttcctttatttcagcaattactctataggaaacagagcactcattgggaatattttttctctttggaatttcaagtgttaaacaatatctgacctttaatattgtttgccaacctttattttttggagaatatcagtgattccgtctttt

SEQ ID NO: 3911 - DNA, 779 bp, Homo sapiens
  ENST00000442513
ggcgctggcgccggccgaatccggcccgggaaccacctccaggattcactgcctgtcgcttgatgttgtccgtcttgggagtctgaagctatgggtcttctccagaaaaaacaaaaccgaaaaaacacacaaagatccacactaattaacattccatttcagaggcttcgccgaccagccccatggcctgcgcaagggccccaaggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaag

SEQ ID NO: 3912 - DNA, 964 bp, Homo sapiens
  ENST00000594033
gctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctggtgctggctggatctccagtcttgggagtttaggttcctgtcttccttgggaccattcaggaatactggaaaaatggagcgaacccagcagctttgaggacagatctctgttctggtcttctgcccataatgtcgcttgttggaaactgatttaagccagtgagcttatttctaattgtcaggcagatattgagagtctgaccctgacagcatgtgggagtcataggtccactcctcagcagccttgctacaggtggtcggctgcagcgaacaggtctgagaagacactctgcaacacatatgaacacttactagcaagcaggcaaaaagatcattgtgtttgtaatctcacgaagtcccagctgcagttcctagtggggaggctttgatggccgcagcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcact

SEQ ID NO: 3913 - DNA, 2801 bp, Homo sapiens
  ENST00000413369
gctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttaccattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttccgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatga

SEQ ID NO: 3914 - DNA, 1532 bp, Homo sapiens
  ENST00000598644
aatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagtttacccaacagcgtcttcctggtaccagataactagttgaaacttggagcaggtccagttggttgaccagttgctctcccatcaactcattttccttgcaccaagatgactttaaccaattggttagcgtgctctagacaaacctgcctgaaactcacctggggaagtgatgacaaatccaggagaggatccactgtggatctggtggctgaagatctggtaaaatgatgccatgggcaaggccgccatgggctcctgcagcaagtggaccatgtactcatctcaaggctatagaggctctgtagcctgcagggccacattaacaacattcacagaagaggctcctggtgactccattccaaagccaggatactttagcttcttgaacttttatgtcataaggtcagaaatttaccaaaggatgcttttccttacttagtgaatcttatggctccttttagaaagcgtgggaacaaccaaggtcagaatatgatgtttgagtgtaaccaaattctcctactgcccctggagcttaaagcatctgggccacatgggaatgtgcactcttaagctagtgctaagaaggaagattgatggtgagagtttgcccccacgtagacagcccccagtcttgcattgtgccaataaacagtctctaggagagggggctgagaaccagctgtaactgggttaaaatgcagatgtcaggagaagacgatcaaattgatgttcacaagtgttttttgaagccctccctactcggagagaaaaaattcacttttttcagcttgtcaagggaaacactgcttactcatatgagggactcattttatgtgccccaagcttgaagttgatggaaaggagcagcagcattttatgaaagcatctgaccagggtgacgtgagctcacgacatagtcgttctttacttt

SEQ ID NO: 3915 - DNA, 1267 bp, Homo sapiens
  ENST00000594371
taaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagaattaggaaacatctcacagagtgaagattgactgcatacctctaacagagcctgatttaagacaggatttgtgagtttggtagacaatcctatgaagttttcattttactgttgactgaagaccatacactgtacggtgacccttattcagaatttttatcagaaacctagggcccctgaacatgagtatataaagtctgatgcaggcctataccctattggggatctcatgtgctcacagtacagctacgctcctctcaaagagacatcatagctaaggaacaatgttttaaaaacaagtaccagtgcaaattaattagaaacagggcactgcctgacgttaggaactctgcattcagagtgtagatctctcaaaagtacagttagagacatctggtcaggatgaagcagtgtgcgcaaactgcaatgaaccttttttgtgcaaaattactagttagtgacaaacaaaatataaagagacctccaaaaagacacactcaggctcagaaacaagctgaacaactccacagagcaggaacagcatagaaatgctgagtgggttgcagggtggagccacaggcttgcaggctccaggttttgaagcagtcaggcagtgttggagaccactccatggggtaaaggagactgcaagtgtctcactgattcaggggatccgcacttggcctgcagccaggagaagaggtaagctgccccacctttgcacttcccacgaaaggaagctggaaaccctctgctgacctgttgcctgg

SEQ ID NO: 3916 - DNA, 589 bp, Homo sapiens
  ENST00000488358
ctttgagatcaattatgtaagaaaggaacaccacctggtccctggcttgtccctcacggtcaccgttacattttctccagatgagtggcgatactattatgactgcatccgtgttcactgtaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttaccgtatggcgtctttgcagtgtttttgtttatttttaacccttttttgaaaatccaagtcttcctttcttccattctgtctttcttgtaaaagaatgtcatcaaaaacttatttaaaatgatgagccaacataagatatactgtaaaacataacagaaatatagaatatatctatgctagtagcaagagttgcttctgacaag

SEQ ID NO: 3917 - DNA, 759 bp, Homo sapiens
  ENST00000475569
ttcggtgaggccgagctctgtggtagagactgccttttccctatcgctgcaactctggaaaataaacttaacagtactcgagaggtagcaaggacagtggggtgaggagtatggatacccagcacaatcgactacattaaatcatggttctgccactaactatgtcaccttgtgtggaacacttaccctctcttgtgcctcagtttcctcttctgtaagtggggataatcacggcaccacctcataggattaaaatagttaatacatgggaaatgcatggggttactcctggcacacaggaagtgccagatcagcattggcagtcatcattgtttattacgtaacttgagtctccattccttgctaccaaaagaaccagttataaagaaaaataatatttttattttcttttttgtttgttttgcagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttaccgtatggcgtctttgcagtgtttttgtttatttttaacccttttttgaaaatccaagtcttcctttctt

SEQ ID NO: 3918 - DNA, 743 bp, Homo sapiens
  ENST00000594141
gttattcctttgcagtgcagctgccctgtagattttgagttttatatcaccttgattcagtctcatcaagcctttgctattgagccaacatcaggaactagaagcatcatctacgcacaccttccaggcattttatgctgaagtttgccaaatgaaaaaacaatttgaatcaagctattaataattctatttataaggtatgccctcaactttaactcaactggccatccttaagatgcaggtgggctctgtagccgtcaaaagctggacctgctgttgttgggggccaagatattcctgaggctggagaaaatgaataaaggattttatgaccttcctgtactgctgacaagaaatcatatgcaaccaaaacttcaagaacactctgttgataattttggaagagccagcaatgcacgactttggccaagatatttttttttccgtgaaatctgaagagaagtattgaccaagatcttattagcatcggagatcaggcaaatgccacaaaaaaattgttgaacttgtctacttgtcactattttgtgatcctggacattcccttgttgtcacaaatgctagggaagaatgcatctaactcatataaatggtaaattatagcattaagtggctggctaagcaagagttccttgggggctgttgcttagagttcttatataaagtttcaataagttcattctctttttttaattataagaaaaatataagccacttacaaataa

SEQ ID NO: 3919 - DNA, 837 bp, Homo sapiens
  ENST00000597189
aatcctgcaaataaccatcattgaaatcactcgggcaacaaacaagtagaactgaacacaaattttaaaactgctgatttttctggtggcaaataagcagattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtgctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttccc

SEQ ID NO: 3920 - DNA, 401 bp, Homo sapiens
  ENST00000599827
aggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaaggtgaagtatggctgcaaagcacagagatgccgagactgatcatgcctctgagcgtgaactttccttagaatgaagttagctctatgcaaataaaaaattttcaccagtcacaaa

SEQ ID NO: 3921 - DNA, 3294 bp, Homo sapiens
  ENST00000443972
ttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggttgaaaaggtcgtggccccttggaaagattgtattgactgtgttggggatctggtgccacctggtggttgccacaagaaaggcctctcctgactcccaagttgtaacccgtttccaccaaatcgacttccaaataatatttatcagatcatcatctgtgcttttcttccttgtttcagaccacttttaggtggaaaaggcaaagaaggcttatatgtattttcttccataatgagtccatcagaaaaagttccttcggtgaaatcgttgaccacgtgatgtttggggactccctatgggatcaatcatccgggttccttagagaccatggccataatcaggggctggccaagggaatgagtatccctgggttcaacagctgtttctgaagacctgccagttcccctgtcttgcattaactcgggttatcatgccattctccttctaaggccaaagatacctgtaaccgaagaatcgggatacttcactgcagtcacttcatttttttttcttttgaggcagagtcttgctctgtcacctaggctggagtgcagtggcacaatctcggctcactgcaacctctgcctcccaggttccagcgattctcctgcctcagcctctcaagtagctgggattacagggacccgccaccacgcccggctaatttttctatttttagtacagatggggtttcaccatattggccaggcttgtctcaaactcctgacttcaagtgatccacccgcctcagcctctcaaagtgctgggattacaggcatgagccaccatgcctggccaagcagcttcattttagaagtgattattattgctttcctttctagaacttccggtttgtgaagtattttctcaatgatcctcaaaacattctaagacataaagtagctgttattagtgtgattttatgcagaaactcaggcccagaaagcttcatggacttacccaattagcagaagagccaggtttgggcaggatcttggtttcctgcaaaggtttcgttgcctagccaggcgtggtggtgtgtacctgtagtcccagctacctggggggctggggtgggaggctcacctgagcccaggtagtcaaggctgcagtgagccatgatcctggtacccagtccactcttctctctactacatggtaatcaatgaaaatattacagatttacattttttaactttttatttaaactttcagctttggagtctctaagagtaaagatattatgtgatgatatttgtattttacttaattgcttattctttaaaacatgtaatatagaaaaaaatacaaattagcaaatgtcctttgctctaaagaaatcagctggcaagtttgccccacccagcagcagccatgtcttactcatttctgtatccccagcatgcagcaagatgtttggcacaatgcaggctctcaataaatgttttttgaggctgggtatggtggctcacacctgtagtccctgcactttgggaggctgaggcaggtagatcccttgagcccaggagttcaagaccaccctgggcaacatggtgaaaacctgcctctacaaaaaacacaaaaattggccgggcatggtggcccatgcccagctacttgggaggctgaggtggaaggatcacttgagcctgagaggtcaaggctgcagtaagccgacattatgccaccacactccagcctgggcaacagagcaagaccctgtctcaattttttaaaaattggctaggtgcagtggctcatgtctgtaatcccagcaccttaggagaccgaggtggacggattgcttgagctcaggcattcaagaccagcctgggcaacatggcaaaaccccatctctacaaaaaatacaaaaaagattagccaggtgtgttggtgcacatctgtggtcccagctactggggagggtaagatggaaggatcacttgaccccaggaggctgaggctgcagtgagccaagattgtgccactgcactccagcctgggcaacagagcaagaccctgtctcaaaacaatagcaataatgtttgttgaattaaggaatataaaagaaatgtgaaaact

SEQ ID NO: 3922 - DNA, 440 bp, Homo sapiens
  ENST00000600951
tcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttacaagctgacatggagtcacagagtgttagtgctagtgggagccacagacagcattagctgatgcctgtcctatgcctggcttagaaactggacattattcccggaataatgcactggaaaagcttccagtccctggttctctcctccctgccggacccctccaagatggagaccacaaagag

SEQ ID NO: 3923 - DNA, 450 bp, Homo sapiens
  ENST00000434869
agtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacggagcacctggatctgctgctgtatctgtgacgacagagtcggggtatagcacaaagaaggccaccagccctgcatgacaagagctccggcacattaggaagactcttggtcccagagttcctccctacccgctatttcctgaactcctgttactgaagacccattcctttagctttgcgctttgtttctattaaactacctctggggag

SEQ ID NO: 3924 - DNA, 545 bp, Homo sapiens
  ENST00000464578
tacctcattcataaagatgaaaaaccagccagcattgactgagcacttagaagacctcacaccaggatctctgtgaataagatctcatttcacctttgctacaatgctgggagatgggaattacaccattcgcacatcaggaaacaggggctgtggattcttgggtaacttgcccatgctcagaaactgatgcagctgaggccagaagccaggtttgaatcattcataagctgagtgttttcactgagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttccgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatg

SEQ ID NO: 3925 - DNA, 1794 bp, Homo sapiens
  ENST00000457071
tgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaaagccagacttcagaagctgttcggaaatctagagaagacctggatgtgtgcaaggagcactatgacaacttactggcagaagacaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagt

SEQ ID NO: 3926 - DNA, 3198 bp, Homo sapiens
  ENST00000434629
gacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaattacctgcttggtagtctgagtactgattttggggtagatacctctttattgtcaagccaattggagcttcattccagagaagagaaaatcaaccaaattatattattgaaagatatcatttacaaggtaaaaactgttttcaataatgagtttgacgctgcatataaacaaaaagagtttgaaattgcacgcgtgaaggaaagaaatgttcgaattcgagaaattattttagatctggaattggaagaagcagtctggcaaccagaatttgaagactgtgagaagccagagagaacgcttgttgtgcaagatgaggagattacagcccacaaacacattaagccgtggcacaaagccaaagaattgatcgtgaatcatgaaaaggagcactggcttctgatacaggatgccagtacaagactccgagctctgatggacatgatgggaggagttctggaagtcaagaaggaagatattttgagaatggtgattcctcaacctgctttcatggcaaaacctgatgctgtgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaa

SEQ ID NO: 3927 - DNA, 526 bp, Homo sapiens
  ENST00000479392
caggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaaggtaaattctccctacccccctacatagttttaattttattcattaatgtattcattcatttaaccagtatttaataagaagcctctgtgatatcaagcatattctaagccaggagtgtttcaaaatatatctgtgagttatttttcttccaacagtttacatttgc

SEQ ID NO: 3928 - DNA, 2963 bp, Homo sapiens
  ENST00000278064
acgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacagaggtggccaaagacattttacagatatccacagtgtctcttttagaaacagacatagtggaagtgatggtgctttcctcgcttccagaagcagggagaagcaggttggagatgttcacactgcctacattactgccacaagtttccacaacctttgctgatgaaagaggaaggctgaaagatgaaatcattcataagtacctgtatgagttggagcacgctctgtcctctgcagtcttgggctttcaaagtaaccaaatatatggcttctgtagtcaagtgccatacatctgtagctaccttcttcctgaagaagaacataccggtatctacattcttaaaccatacaaaaaagtacaaagcagacagtatggacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaagtactattttaaatatacatgtgtttatataagtga

SEQ ID NO: 3929 - DNA, 2876 bp, Homo sapiens
  ENST00000369720
ccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtgtaagtcctttctgcctccaggagcggctccgtgtcacacccgtctgttgaaaattctagtgaagccatcctttcttttaattttaagttttacgtgtttcatttgttttgaatgttaatatattcacacagttcaacactcaaaaggtacagagggctgtgtagtaaagtaccccccatacccaggtctgtccttgcaggcagcctggtaccaatttctcatgtctctcctgagatgttttatccatgaacaagcaaaacataataagcacttctttttacttgtatcaatggccatcatgtgtgtatagtgtgccaggcacttctgctgtattaactccatgaggtaaacactcttgttgtctctatttgacaggtgaggaagataaggcacaaggattttaaataacttgctcaatagtacacagatagtgaatggcaaatgttgggatttgaacccaggtagttgggctgcagagtcactgcctttgctcttaaaaggagaaaactatgtacaatgcctcatttcttttttcacttaatcgtatatcttggagaatgttttatatccacacataaagaccagcctgattatttgtatagccacatagtattccattatatgaatatactatcattttttaaaaacggtatattaatgaacatttagagtatttcaaaacttttgaagcaatacttttaagatgataatatagagacattagatttggacttgtaggtgctatcattattactgtttctttttaatttattatattattaggtattaataagaacagacatttgtattctgctttacagcttgagatcactgtagcttgtggcatgtgatcctcaaaacaccagtcagaaaggtgttattcttatccctattagacaaattagggaattcagggttagagaggtgaggaaaagcattgtccaagattacacattacacagctagcacactgaggagctggccctgccactgtggactgcccagctccaccaccctagctcagtggggaaggatggataacctccttccatttaccccctgcctttctgcactgtcatttttttgtgcctttcctttctcagatcctcttattctaatttacatcttcccactttttctaatttgataaagttgtagacatgtttcactacattcttcctcccactgccaggtaccagacacagggtaatgaaatgtcacacccaccactaatttgagaattgcttatttgcgcttgaaacatcaagaaagctctaccgacagacatgtttcattcacttatgatgaaccaactgcccatctttactgaatcttcttgactgtatttattaaagttgcaatttggaaata

SEQ ID NO: 3930 - DNA, 1434 bp, Homo sapiens
  ENST00000369719
tcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaaggtatgttggatggtaatttcttgatatgtgattttcagatagtattattatcatcattacatgacaggaatgaggagcagagtatgctgcacagtggtactctacttgtcaagactctaggttgtaaatgaaaaaatacccaatttaaaaggcctaaattacaaagagctattggtttatttttgtgcatgtaactgaaagggcaaggagtgaatctgaataaaagagctaccatgatgcca

SEQ ID NO: 3931 - DNA, 5365 bp, Homo sapiens
  ENST00000357060
acgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacagaggtggccaaagacattttacagatatccacagtgtctcttttagaaacagacatagtggaagtgatggtgctttcctcgcttccagaagcagggagaagcaggttggagatgttcacactgcctacattactgccacaagtttccacaacctttgctgatgaaagaggaaggctgaaagatgaaatcattcataagtacctgtatgagttggagcacgctctgtcctctgcagtcttgggctttcaaagtaaccaaatatatggcttctgtagtcaagtgccatacatctgtagctaccttcttcctgaagaagaacataccggtatctacattcttaaaccatacaaaaaagtacaaagcagacagtatggacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaattacctgcttggtagtctgagtactgattttggggtagatacctctttattgtcaagccaattggagcttcattccagagaagagaaaatcaaccaaattatattattgaaagatatcatttacaaggtaaaaactgttttcaataatgagtttgacgctgcatataaacaaaaagagtttgaaattgcacgcgtgaaggaaagaaatgttcgaattcgagaaattattttagatctggaattggaagaagcagtctggcaaccagaatttgaagactgtgagaagccagagagaacgcttgttgtgcaagatgaggagattacagcccacaaacacattaagccgtggcacaaagccaaagaattgatcgtgaatcatgaaaaggagcactggcttctgatacaggatgccagtacaagactccgagctctgatggacatgatgggaggagttctggaagtcaagaaggaagatattttgagaatggtgattcctcaacctgctttcatggcaaaacctgatgctgtgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaaagccagacttcagaagctgttcggaaatctagagaagacctggatgtgtgcaaggagcactatgacaacttactggcagaagacaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagta

SEQ ID NO: 3932 - DNA, 8278 bp, Homo sapiens
  ENST00000368586
caaccgtggccgggtcctcgcggctggagaacccaaccgacagtgggcggcaggacgcaccgcggaccccggagagagcggacgagcagggcgccggcgccatggacctggtcatcacgcaggagctggcccgcgccgagagccagcaagatgctgcgtccttgaagaaggcctacgagttgatcaaatcggccaacctagggaaatcggagtttgacccctcagagagcttcagcccagacctgtttgttctgtgtgcagagcaggccctgaagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggaggaatttgaaaattgcgtgactgagtacatgaaggccataaactttgccaaaggagaaccgaggtactactttttggtgtacaatgcatcagtcctctactggcagatggtgaggccgttcctcaagcctggatatcgtcaccatctgatccccagcctttcccaaatcataaacgtgctgagtcagactgaggaggaagacaaggagtggcgtgctgagctgatgctggaacttctggagtgttatctgcaagccggaagaaaggaggaggctgccaggttctgctccacggcagctccgttcattaagtctcacgtgccacagaaataccggcagatattctctgttatggttcgtcatgaattaatggacgaacttcagttaaaggaagaaaagaaaaattccattagcctgtcagtcactttctatattaatatgctaaaggcaaaagcggagcaaaatgatttaccaggtgacatcagtgtcattctgaggaaggcctacagacacttaggtcattacaaccaccagcgctttccctctatcagtgaagaaaaaatgcttttgctttttgaattggcgcgtttttccttgaccttgaaatgcatggagatctcctctgcctgcctctcagacctgaagaagatggaaagcaaagatcctgggaagcttattgaaatggaatgtctggagtgtgaatcggaagctttaagacttgaaagtaagatgaaagtgtacaaccgagcggctgttgaggcccagctggatatcatacagaggctagacgtcgcgctgcagcgagccgtgcgcctgggcgacccccgggtcatccacgtggtgtgcgccacgcagtggaacacctgcctgcccctgctgcagcacaacctgcggcaccacctgcggaagcccctggctggcgttgcggacgtgctggagaagctggacagcctcatgacgcttctccgctgtcaagtgcacatggagatggcgcagatcgaggaggacgaggaccggctggagcccgccacggagcacctccggaaagccgcgcgcctggacagcctgggcctctaccgggacaggatccagatggcctccacccggctgcgtctgtgcaccacgctataccaggcccctgagcgcgcagaggacaaggccatcatggccgttgagcaggcaaaaaaagctacaccaaaggacagcgtcaggaagaagcgggccctcctggtgaatgcaggcctggccttagcccctgacgcgtttcagattgtgctggacagtgagaatgaggccaaagtctccaccgggaagaacaggggccggttcacctacctctgtgcgaaggcgtggcaccacaccgtcagcgtggacaaagctgccgggcacctgcggcgcctgggcaacgaaaacgacaaggagaggatacagatttgggcagagctggccaaagtggcccggaaacaaggcgtgtgggacgtctgtcggacggcgagccgcttctgcctcctgtatgacaacgtcaaggtgaagaagttgaggctgcggcgagggaagaagaagcgaggtagggacggctcggtgcaggacacctggagccagcctgaggtcgtcctgcagaggcaggtgtgccccgacctgctgcggaagttcgcggaggtggggttcatccatgctgaggccacggttcatttgctgcggtcagaaggtgtagagctgaatgaccgggccatcccccccgaagacctgagccagcacccagctggctacgtgcctgagcccccggaggtgaatgctgagtggatcacatacagaacctggatcgagagtctgtcccggtgtgccatgaataactggctgcgctccgcagagatcggacaggagatccaggaggcgtggattgtgcagaacgccgtggtctacgtcctgaaccacaaccaccacctgatcctggccgggcggcagaaggagctggtggacgccctgtaccacctcctgagcatcgttaaggccacaggccacagtggggaccccgtgatgctggtgacgctctgcaacaccttggcgcgaggcctgatcatcagctggattccagtccaggctgccgagaagtccaggaaattcatgcgaccaaacgcgtttcacagcccactggacgcaggagccacttccgagatcaaaacagcggtggaggtctgcgagtttgccctgaacctgaccaatgggagtgcgcccgaggagacggtgcccaccggcacccggcagcagcttatcgccacctgggtcaaggccaagcagctgctgcagcagcagattgggccacggctgggcaccgaggagcagggcaccaatgaggatgtcagctcggtgaccagagtcctcgttgccttggaaatgtactcatgcaacgggctgggcctcatggacttcactgtcccctccctggcccagttggtgaaaatggcttccgagtgcaactggtcggaccccctggtggagctgcagaccctgacgcggctgacccacttcgcccatgcagcgcgtgaccatgagaccaccatggcctgtgctcacagggctctggagatgggcatcaagtacctgaagaaatttgggcccgaggagtcccggctggtggcagagatgctgtgcacagccacggccatccagggcaggagcatcatggaaaacctgaagggccggaagcagctgcgactggtggcagccaaggccttcacggagagcgccaggttcggaggcatcgcgggcagcagcgccctggtgatgctggccgcgcggcattactggaacgcctggctcccactgctgtcctcagccgtctacaggaagaaggccaagggtgccctgaagaggctcatcggcatcatcaacaagacagaggccagaaagcaggagaaaggaaagacgctgcttctgcaccagtggcccacggccgacttccagggtggcgggacgaccgaaggatattttcttccaggggctgaggacgacctggcgctccgtgctgcgctctacggcctgctcttccacagccatgccgaccaggacgactgggagggcggcctcaaggtgctggacgaggctgtgcaggtgctgccaaggacggcccaccgcctcttgatcttcaagcacatggtcatcgtgaaggccaagctcgggcagaatttttcgatggaaatacagaaattcaaggccgagagtgaggactacttggcgcgcatgtggcaccgcctggccctgaactcgccgagcgtgtctggagagctggcctgctacaacaacgccatccaggccttgcagaagcctgagatggagtggcagaaggtggagtacctcatggagttcggccagtggctccatcacagacactttcctctcgaggacgtggtcttccacctccgctgggctgtcgagatcctgctggccatgaagccgcccggcgatgtccctgagccacagcccacgccggatggggagtacgtggctgtggagatgcccccacggagccccgtgtccgaggccgaggaggcggtgtccttggagcagctgcgtagcgtgcggcagctggaggcgctggcccgcgtgcacatcctgctggccctggtgctgtcgccgggcgccgagggctacgaggactgctgccttgcagcctacgccttcttcaggcacatctggcaggtttctttgatgacagcaggaaaatcagttctggaaaacagacccctggcagcaaccagctcacatctgttattgcctaaaaaagagaaggagaatgagaggagtaaagagaaggagaaggagaggagtaaagagaaggagaatgagaggagtaaagagaaggacaaggagaagggaaaggaggagaaagtcaaggagcccaagcagtctcaaagcccagctcctatcaaacaactggaagacttacccatgagcatagaagagtgggcttcctactcctgccccgaggaagtgctgtctgtactgaaacaggacagaagtgactctactgtgaacccctcaagtatccagaagccgacatacagtttgtatttcctggaccacctggtcaaggccctgcagaagatgtgcctgcacgaactcacggttcccgtcctgcagttgggggtgctgatttcggactccgtggtgggaagcaagggcctgtcggatctctaccaccttcgcctcgcccacgcgtgctccgagctgaagctgagagaagcagccgcgcgccatgaagaggcggtcgggcaggtgtgcgtcagcgagctggagcaggccagctgcagaaaagagatcgcgttgaaaaaagagaaaaataaggagcctttattagaagaaagcctgccagcactgaatgagcagacacttcctgtccagcctggggagatcaaaccactggacgccaaggacaagattttgaagatgaatggggagaccgggagggacctggatgggacgtcctttccccacctgtggatgctgaaggcagaagttctgctggagatgaacctgtaccagcctgcacggctgctcctgtcggaggcttacctggctttccaggagctggatgagccttgtgcagaggcccagtgcctgctcctcctcgcacagttggccaacaaggagaaaaactatggacaagccaagaaaatgatcgcacaggcccagcacctgggcggaagtgaggagttctggtacaattccactctgaccctggcagaggcgctcttgtccatggaacactcaggaagggaagctacggtgtgtcacatatttcagaagctcatcaatgccttcaagatcctcaagaaagaaagaccaaaccgattgcctttactggaattcatgatcacagatctagaagccaggtgcctgagcctgcgggtcagagttgcgcagcactcagcggtcactgaacccacagagtgctcgttgctactgaaagagatggatgatggcctgttggaaattgagagaaagtttatcgactgtggctgcaaagagaattgtgttgacgtaaaactagagcgtgcgaagatcaagaggttacgtgcccagaacgagaaagatgaagaacaaaaaactgcgtattacttggaagcgtatggcctggcccagggtgccgtagctgaggaagaagggaggcttcacagcatccagggcttatatggcctggcccagggcgccatggctgaggaagaagggaggcttcacagcgtccagggcctattgtcacttcaagacttgcagaacgtcaacacgcccctgatgaggaagctggcgcgcctcaagctcggcctcgtggaaatggctctggacatgctccagttcatctgggaggaggcccacgggcagcagagtgagcaggggtccctggagaagctgctggcggactatctgcagaacaccagtgactacacttccgtcggcctgcaatggttcacgctgaagcggactctagcacacggggcactggcacagctggggagcctgcagccgctgagcgtgggctgtgtggagatccgcgcccggctcctgggcctggccgggagggccctgcacctgctggccatgcaagctgaccctgtgcaccctacctgctactgggaggcgggcccctcggtgggcgccaagctgagcggcctcaagtctctggagctggaggtagaggaagagggtgccacaaagtccagcagggacccgccggcctccagggcagccccggaggagcactgcaggagaggcgaggacctgaagaggaggatggttctggcccagcagtacctggctcaggcgtcagaggtgctgctgcagtgcctacaggtggcccttggcagtggcctcctggatgtcgcagcagccgccagcctggagatggtggagtgtgtcggcaccctggaccctgcaactacctgccagttcctggctctgtctcagagctgctcggcctcagagacgatgagggatgtcctgcttgcagccacagccaacaccagcagctcacagctggcggccctgctgcagctacagcaccagctccggtgccaagacaggaccaccaccagcctgggcgcccgtgtggagcagaggctggccgccgtgtccaaggcttggcaaaatctctgcgtcactgagcagcattttaacctcttgaatgagatgcctccgaccttttggatcctctttctgcacctctcaggggacaggtcccgtctgtacggcgctgcctacgagaaacccaagttcattactgcagccaaaggaaaggtgcaggcggtgggaggctcctgcaaggtgatgcgtctggccataagtcccactgccttctcccacctgctggcctgtgcccagcagttccggaagcagacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcgcagacagacatctcctggagctgccactggaaggtctctctgtgttcgatgaagggacaatttcctctgtgtcacgagaattttctcttcaaatgctgtggaatcgcctccataaagaagagacagaaggtggcgtgaaaaaggagggaagaagcagagaccccaaaaagagaagcctagcgaagaagggcaggaagggcagcatcccccggaccatcccccctgactgcatcatagtcgactcagacaacttcaagttcgtcgtggacccatacgaggaggcccagggcccagaaatgctaactcctgtctccatcacccaagacattttggaaagattccaagacacattcacgtcgcgatgggcgggacatctgggaagcaagcactttcccagccaggcccagtgggagcaggccctgggcagctgcagcggtttcttcttctatggaatggagagcttcctgtcccatatattagtggagagattggtcgccatgaacttgcaagagtgccaggtggcagtcctgctggacctggcgcggtcctaccagagcttgaagaggcacatggagagcgtggagcacaggagatctgttggccgttgggaagccaattggagaaacagtgcgtctccttcagaagatgagtggcgacgaggcggtgaaccaagacgaggcttctcagaccttgaaggacaagctgctgctgctccaaagctccgagctccttcccaccacgctcaacttggtcctgtatgggctgccgcaccaagccatcgggtagtgcaggcctggacctgcctcccatcagctgctggggccccagcacttgcctctgcccttggctctgcccctctgccaacccatccccacctcccggctcccatccccagctcccagctcgctctccccttcctgggcctctccccagcccttggtgcagcctcagccagggaccctcccccagcgacttcccgcaaggcagccgcctggacctcgagctctgcctgcctgtgtgcgccatggggtctgcgtcggggctggagctgcgtctcttcccggggccaggacaagggcggcctccccttggcggcgctggtgctgagttgcttagaccagaagactattcagaccgtgagcctgtttttgatttgagtgttccactaaacaaacaacaaaagcca

SEQ ID NO: 3933 - DNA, 782 bp, Homo sapiens
  ENST00000639072
ggtcgccatgaacttgcaagagtgccaggtggcagtcctgctggacctggcgcggtcctaccagagcttgaagaggcacatggagagcgtggagcacaggagcgcctcacagctgtccctggaggagcccgttgaggcggccatcctgctgagcctggtgggcgtcaagagcatcctggcaaaccagtggccgacgctgctgcaggacaacgcgctgcgggccagcgtcttatgggaaaatctgttggccgttgggaagccaattggagaaacagtgcgtctccttcagaagatgagtggcgacgaggcggtgaaccaagacgaggcttctcagaccttgaaggacaagctgctgctgctccaaagctccgagctccttcccaccacgctcaacttggtcctgtatgggctgccgcaccaagccatcgggtagtgcaggcctggacctgcctcccatcagctgctggggccccagcacttgcctctgcccttggctctgcccctctgccaacccatccccacctcccggctcccatccccagctcccagctcgctctccccttcctgggcctctccccagcccttggtgcagcctcagccagggaccctcccccagcgacttcccgcaaggcagccgcctggacctcgagctctgcctgcctgtgtgcgccatggggtctgcgtcggggctggagctgcgtctcttcccggggccaggacaagggcggcctccccttggcggcgctggtgctgagttgcttagaccagaagactattcagac

SEQ ID NO: 3934 - DNA, 610 bp, Homo sapiens
  ENST00000448925
agacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcgcagacagacatctcctggagctgccactggaaggtctctctgtgttcgatgaagggacaatttcctctgtgtcacgagaattttctcttcaaatgctgtggaatcgcctccataaagaagagacagacagtgaaaagcacgagggagcgcgcggaaggccctgacctcggctgggattcgggggtgatgacattctgtgactgagtgctggctgtgcagacgtgccccggttgtgaagcttccccgagcgctacccttgcggtacgtgcagttttctgcacttcggtatcaaataaaattaaaaataaatcga

SEQ ID NO: 3935 - DNA, 563 bp, Homo sapiens
  ENST00000476633
acttccagcagggccccccaccccaagggcccagcctcgggcaggaagggtacaaagcccccgccgtggctctgccacgaggtctcctggaaatgaggggaacagcacagcgacgtccttgcgtcctaaatgcatcccctgatggccgtttttcgccacacaggcttggcaaaatctctgcgtcactgagcagcattttaacctcttgaatgagatgcctccgaccttttggatcctctttctgcacctctcaggggacaggtcccgtctgtacggcgctgcctacgagaaacccaagttcattactgcagccaaaggaaaggtgcaggcggtgggaggctcctgcaaggtgatgcgtctggccataagtcccactgccttctcccacctgctggcctgtgcccagcagttccggaagcagacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctat

SEQ ID NO: 3936 - DNA, 394 bp, Homo sapiens
  ENST00000417862
agagtgggcttcctactcctgccccgaggaagtgctgtctgtactgaaacaggacagaagtgactctactgtgaacccctcaagtatccagaagccgacatacagtttgtatttcctggaccacctggtcaaggccctgcagaagatgtgcctgcacgaactcacggttcccgtcctgcagttgggggtgctgatttcggactccgtggtgggaagcaagggcctgtcggatctctaccaccttcggtgggtacagctcctttttcggagtgtgatttccccaaagcaaaacaaaaataaacaacatgttaaggtattaattctgtagttgactgtgtaaataataaagtccctgggacttgaacaccaagtaaataaaaatatttgaatatga

SEQ ID NO: 3937 - DNA, 1675 bp, Homo sapiens
  ENST00000486104
gccacggttcatttgctgcggtcagaaggtgtagagctgaatgaccgggccatcccccccgaagacctgagccagcacccagctggctacgtgcctgagcccccggaggtgaatgctgagtggatcacatacagaacctggatcgagagtctgtcccggtgtgccatgaataactggctgcgctccgcagagatcggacaggagatccaggaggcgtggattgtgcagaacgccgtggtctacgtcctgaaccacaaccaccacctgatcctggccgggcggcagaaggagctggtggacgccctgtaccacctcctgagcatcgttaaggccacaggccacagtggggaccccgtgatgctggtgacgctctgcaacaccttggcgcgaggcctgatcatcagctggattccagtccaggctgccgagaagtccaggaaattcatgcgaccaaacgcgtttcacagcccactggacgcaggagccacttccgagatcaaaacagcggtggaggtctgcgagtttgccctgaacctgaccaatgggagtgcgcccgaggagacggtgcccaccggcacccggcagcagcttatcgccacctgggtcaaggccaagcagctgctgcagcagcagattgggccacggctgggcaccgaggagcagggcaccaatgaggatgtcagctcggtgaccagagtcctcgttgccttggaaatgtactcatgcaacgggctgggcctcatggacttcactgtcccctccctggcccagttggtgaaaatggcttccgagtgcaactggtcggaccccctggtggagctgcagaccctgacgcggctgacccacttcgcccatgcagcgcgtgaccatgagaccaccatggcctgtgctcacagggctctggagatgggcatcaagtacctgaagaaatttgggcccgaggagtcccggctggtggcagagatgctgtgcacagccacggccatccagggcaggagcatcatggaaaacctgaagggccggaagcagctgcgactggtggcagccaaggccttcacggagagcgccaggttcggaggcatcgcgggcagcagcgccctggtgatgctggccgcgcggcattactggaacgcctggctcccactgctgtcctcagccgtctacaggaagaaggccaagggtgccctgaagaggctcatcggcatcatcaacaagacagaggccagaaagcaggtgcaccagccctggagggggctcctgactcccactgaggcctctagtgggtcttccagaaaggaccggagagactcccaaagaaagacagaccccacaggcctcccagagggtgcaccagcaccagccgaggaggggagggggttaaggggggtctccaagtcccagcactgcgggggcccctgctggactcggtgctcagacctgacctctcccagcaacacacatgcaccgaggggctctcagccctggagacacacagcagcgggtagagtgaggccagcacagtccctgccttaagaggcttggattctaggcagggaggacaggccccacctgccatgagagagggtggccctgagaacagcaagcagagggcagggcagggggcgggggctgggccacaggtgcctctggcggcttaaggcagagtggggtggcg

SEQ ID NO: 3938 - DNA, 573 bp, Homo sapiens
  ENST00000466834
ttcgtgaccgagaacacgtctgtcctaggtctgcgagtttgccctgaacctgaccaatgggagtgcgcccgaggagacggtgcccaccggcacccggcagcagcttatcgccacctgggtcaaggccaagcagctgctgcagcagcagattgggccacggctgggcaccgaggagcagggcaccaatgaggatgtcagctcggtgaccagagtcctcgttgccttggaaatgtactcatgcaacgggctgggcctcatggacttcactgtcccctccctggcccagttggtgaaaatggcttccgagtgcaactggtcggaccccctggtggagctgcagaccctgacgcggctgacccacttcgcccatgcagcgcgtgaccatgagaccaccatggcctgtgctcacagggctctggagatgggcatcaagtacctgaagaaatttgggccgtaagtaaccctcatgactggacaaattccctcaaaacgggcagggagcgcaggcctgggcctcaatcacagatcagggagcaggtgagcgccccaccagttccccaaaacgggcaggga

SEQ ID NO: 3939 - DNA, 1825 bp, Homo sapiens
  ENST00000368585
gggcacacaggagccctgagcggggagaggaggcccgcgcggagcccccggcgtccccccacgccgccttccctcccctttcttcttcccgcccctcgccgggggtcgctgccctggtgtctcactcccgcggagctggcggggggcagggcgggggcgcggcgttgttcgccttccccgaagtgtggccccgccgccgacccgtagccccgcgtccgcgtccctttcggtctccaggcaaccgtggccgggtcctcgcggctggagaacccaaccgacagtgggcggcaggacgcaccgcggaccccggagagagcggacgagcagggcgccggcgccatggacctggtcatcacgcaggagctggcccgcgccgagagccagcaagatgctgcgtccttgaagaaggcctacgagttgatcaaatcggccaacctagggaaatcggagtttgacccctcagagagcttcagcccagacctgtttgttctgtgtgcagagcaggccctgaagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggaggaatttgaaaattgcgtgactgagtacatgaaggccataaactttgccaaaggagaaccgaggtactactttttggtgtacaatgcatcagtcctctactggcagatggtgaggccgttcctcaagcctggatatcgtcaccatctgatccccagcctttcccaaatcataaacgtgctgagtcagactgaggaggaagacaaggagtggcgtgctgagctgatgctggaacttctggagtgttatctgcaagccggaagaaaggaggaggctgccaggttctgctccacggcagctccgttcattaagtctcacgtgccacagaaataccggcagatattctctgttatggttcgtcatgaattaatggacgaacttcagttaaaggaagaaaagaaaaattccattagcctgtcagtcactttctatattaatatgctaaaggcaaaagcggagcaaaatgatttaccaggtgacatcagtgtcattctgaggaaggcctacagacacttaggtcattacaaccaccagcgctttccctctatcagtgaagaaaaaatgcttttgctttttgaattggcgcgtttttccttgaccttgaaatgcatggagatctcctctgcctgcctctcagacctgaagaagatggaaagcaaagtaagtggcttcatgacactgctgcctggggatgaggcgctgctcaccgtgcagttggacaaaaggcaaagaaaggaagagcagttcaccaggccacggcccccagggcttcggtccgtggttggcacattgccgtctttcctacctgtgttttgcacagttgcagttagatggtgtttgcaattttacacctgcccgtttctctttacctttcttgtggccacgggtccacagcaccacagttgtttctagagtccaatttacggacggcgtaaaatttcatgatgctgatgatccagaacatcctccaccagtcccattattggacgtgtaaatcacaccggcagtgcctcgttacccgcagttcactttctgcagtttgttacctgcagacagctacagtatgaaaatattaagctattctgagggagaggccacagccacatcacttctgttacagtatagtgttatgattgtatcttattattagttattgttataaatatcttattgtgcctaa

SEQ ID NO: 3940 - DNA, 1156 bp, Homo sapiens
  ENST00000475340
gtgggcggcaggacgcaccgcggaccccggagagagcggacgagcagggcgccggcgccatggacctggtcatcacgcaggagctggcccgcgccgagagccagcaagatgctgcgtccttgaagaaggcctacgagttgatcaaatcggccaacctagggaaatcggagtttgacccctcagagagcttcagcccagacctgtttgttctgtgtgcagagcaggccctgaagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggaggaatttgaaaattgcgtgactgagtacatgaaggccataaactttgccaaaggagaaccgaggtactactttttggtgtacaatgcatcagtcctctactggcagatggtgaggccgttcctcaagcctggatatcgtcaccatctgatccccagcctttcccaaatcataaacgtgctgagtcagactgaggaggaagacaaggagtggcgtgctgagctgatgctggaacttctggagtgttatctgcaagccggaagaaaggaggaggctgccaggttctgctccacggcagctccgttcattaagtctcacgtgccacagaaataccggcagatattctctgttatggtaaatcagcgtattagaaatagagacgtaagaagtaattttcttaaaagtcattgttcagaaaactgcgtagaaattacataagtttgctgagagatataaaaatctatatgcatacatacatgaacaaaattacataagcatattaaaaagaaatagcagttcatccaatgcaaagatgtatagaactgtgacatttagaaaacaaaacagggtcttttgcctttatcgtcgctctttaaatatttcctttgtaatagctttgaatttttttaaagttaatagaaaattcacaaagatacaagtaattactacaagaatatgtaccaaaagcattcattcatcagcagtccattttgacatatggggaatcagcttaagttgtatctgaaaagctagatacaaaattaatgagaaaataaaatctagacacaaaa

SEQ ID NO: 3941 - DNA, 1851 bp, Homo sapiens
  ENST00000398545
aatcccgcgaggcgcaccatggcaaccagacttctgcgtcgcggaagcgggtcccgcaggtcgccacggttgggggaaacgcggcggacgccgcccccgtcccgaaggggactcgaaaatgtacagccagcggtttggcaccgtacagcgggaggttaagggccccacccccaaagtggtgatcgtgagatccaagcctcctaaaggccaaggagctgagcaccatctagaaagaatccgacgcagccatcagaagcataatgctattttggcttccattaagtcaagtgagcgggatcgcttgaaagctgagtgggaccagcacaatgactgcaagattttggacagccttgtgcgagcaagaatcaaggatgctgtgcaagggtttatcattaacattgaagaaagacgaaataagctacgtgagcttttagcattagaagaaaatgagtattttacagaaatgcaattgaagaaagaaaccattgaggagaaaaaagataggatgagagagaaaactaaattactaaaagagaagaatgaaaaagagaggcaggattttgtggctgaaaagctagaccagcaattcagggaacgctgtgaggagctccgtgttgaattgttatctatccatcagaagaaggtgtgtgaggagcggaaagcacagattgcatttaatgaggagctgagcaggcaaaagctggtggaagagcagatgttctccaaactctgggaggaagaccgattagccaaggaaaagcgagaagcccaagaggcgaggagacagaaagagctgatggagaacacacgcctggggctgaatgcccagatcaccagcatcaaggcacaaaggcaggcgacacagctgctgaaggaagaggaggcacgccttgtggaaagtaacaacgcacagattaaacatgagaatgaacaggatatgctaaagaaacagaaggcaaagcaggaaactaggaccattttgcaaaaagccctacaagagaggatagaacatattcagcaggaatacagagacgaacaggacttgaacatgaagctcgtgcaaagggcccttcaagacttacaggaagaggcagataaaaagaaacaaaaaagagaagatatgataagagaacagaagatataccataaatatttggcacagagacgtgaggaagaaaaagctcaggagaaagaatttgacagaatattagaggaagacaaggcaaagaagttggctgagaaggacaaggagctgagacttgaaaaggaggcaaggagacagcttgtggatgaggtcatgtgtacaagaaaacttcaagttcaagaaaagttgcaacgagaagctaaagaacaggaagaacgtgctatggaacagaaacacataaatgaaagtcttaaagaacttaactgtgaagagaaggagaattttgcaagacgccaacgtttagcccaggagtacaggaagcaacttcagatgcaaatcgcctaccagcagcagtcccaagaagcagagaaggaagagaaacgccgagagtttgaagcaggtgtagcagcaaacaagatgtgtttggacaaggtccaggaggtcctgtccacccatcaagtgctgcctcaaaacattcatcccatgcgcaaggcatgccccagtaagcttccaccgtagttccgtgagcatcaatatatcttttcttggtcttttaatatttttaactacagtatgcttgtatgcttcttttaactcctggataaacttttcttttttccctgagtttgtgtaattaattgaacataattttcttcctttgaataaacctgtgcctattttggagttcacagacttacaaatccaaa

SEQ ID NO: 3942 - DNA, 1231 bp, Homo sapiens
  ENST00000462684
tggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 3943 - DNA, 1321 bp, Homo sapiens
  ENST00000495161
tggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 3944 - DNA, 1710 bp, Homo sapiens
  ENST00000433268
caggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 3945 - DNA, 6686 bp, Homo sapiens
  ENST00000493787
ggttgctatagttgtcaaaaacataactgaggctgctgcagagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaaggcaatgagtgactaccacatacagatcaagaatatttctagagccattctagatgaatactacagaatgtttggaaaacaggtggccaaactggagagtgatatggatagtgaaaccttggaggagcagaagtgccagctcagctatgaacttaattgctctggaaaatactttgctttcaaagaacaactcaagcatgctgtggtaaagattgtgagagataaatacttgaagacaacatcatttgaaagccaggaggaacttcagacatttatcagtgagctctatgtgttcttagtagatcagatgcatgtagccctaaaccaggtaagtgtcaagaactgagagcactttcttttctctgtagagcatcagagtcttctatgaataattccttcctttgtttattcaacgaatatttattgaagtgtctgctctgtgctaggcactgaaaacacaaagatgagtaagaaactgcctaagcctaatcagtttaagactaattttggaaaaaaacaaggagatatgctctttcaatttcctagaaaaataaatttcacaactttaaaaaatgtgatggaattgtcaaaaatagattaaatatgttgcataaattgtgaaatgaaaattatcattctatttattctgtgaacaggtacaattcttaattttttattgaatatcataaaagcagagaaaaactttgagttttcagatattatacccaaatgacagtgacacttcaaacatgccttttctgtttgactggtggtctgctgtcccacccacttttctgtttatatttgtaagtcttccatcttgccttcatttgcttatttttatttgtattcaggggtagtttatttgaaaccagtgacaaagtcacagtctttttgtcccctggtagtgtctaaccatctgtgcctcctcaaattctttattctatttgcttttcccttccttgtttttcttctctaccaccatcacctcttgtttcactttgttctgtctttctggagaaggtaggacaggagtgtccagcatcaaaggattaagagaacagtcctgccttgggcatggatgatttgatttgaaaagcaattgagagtggagcatgagaaaaagaagttttgactttttcctcactagtagctgggagcaatacattgaattattttacactgaggtataatatgatcaggtttacatttgctaaaacactctgatagcactatggaggatgagttagaggtgacaaaactgtgatgttagttgattattgcataataaggaggaaaaagtttaagttaagtttaagtttcaatgggtaattgatgccattcagtacttcttggttgatactaaaaagaaaagaaaaacattaaccaggacatggaatgcaattatgagtaaatttggtgggaggcagatggtactgaattcgcttttgaacataggctctagtggggttttgcccaagacagagatctgagctagagatgagatttggggagctatgaaatatggatgctatggtcatagatgaactgcctgagaaaaacataagagagaagagagctggcagtagaactctaggaaataccaacatttaaggaatgaatgaaaaattgaaagagacaagtgggattgttaaagaggcaaagagccagagacaatggtgtcacagaagccaaaggaaaagaattttaaggaaaagtggtcaacattgttaaatactcctaggaattcaagaaaaacaaatctaaagtcttcactggatttgacaataaggaagttattgttaacctttacatagcaatattattgggctaatggggggattcaaattatgatgaattgagtaaatgagcaatcaagaaacagatgaatataaattcaagttggatgacgaaggaaaaaactggaaaagtagtagctagaagttatagggattttcttccctccctccctccctcccttcctcccttcctcccttcctcccttccttccttccttcatttctttctttctctttctctctctctctctttctccctttctctctttctttctcgcccaggctggagtgcagcagtgcaatcatggctcactatagcttcaacttcccaggctcaagcaatcctgccacctcagcctctcaagtagctgggactacaggtgcacaccacgcctaactaatttttgtatttttttgtagagatggggtttcaccatgttgcccaggctggtctcgaactcttggactcaagcgatccaccagccatggccttccaaagtgctgggattacaggcatgagccacccgctcctggcctgggattttctttttaagatgaaaaagacttgagcacatccacaggtttgggaaaaagtcagcagagtgggagaagctgaaaattgaggaaagagaggggataattgatggcaggctcagggtatacacctgggaaaggaccaagaatttaaatggaaggattaactttggaacagtgcaggctgcaatacctctttctctgagactgaaaagaaagcgatacaatagatccagaaataaataatttagctagggagtataatagttgagggatttcttacttaatgatttctattatctctgtgaagtaaggtctttactgaaagtgaaggagatgaggattgaatgaaaaacttgaagaaagagaagaaaacttagatactgcaaagcattatggaatatgctgctaagcaaagacaaatacatagattactaagggtattaaaggtctccagctaagactgaatgccacaagagcttgtggcagcttagataccaatctctgtgtctatgcagttttccttaggaccagttagctgctcttgtcttggaatgaagaagtcagattgtgctattgttttaagttgagaattttcaggacaaatgcaggagaaggacaaggatgcctgagatgaaagtatgctggtgagaaagtagcctgagtgggttatcatgaggttcagactgatccatctgggaagtgatgggcttattggaactgaaggaaataaagtcagcagttttcagtgggctaagtaacaaaaaggtggaagacaagacatggagtgttggttctgggagtgggatattagagtattctgttttgggtgtagaagtgcatcgctgcagggatttgggggtcaagataatcaaaactaaaaagaacaggacaaaagtattaatcaatgatcagaaactctctttggcctatctcaaatttggctttactgtccacatttcttagcaattatccttattaaaatcactgatattattttgacttctaattaaagaattttgtggactctttcttgaccatagcttctgactcaggagattcctaattacaccagacctgctctcccaatctttgtgtataggatatattctttttctggttttcctcctacctttttgtttcctttgaaggatctatcagtctatatttcctactaaaactatagatttggcttctaaaggtttacccttaatctcctgttttcttcacatttaaagaccctagcgagggcttgccaacctttttcatgtcatgacacaaaaaaatgatagtatttgtcatatacactacagaaaatgaaggaagctgtttgaggtcagaggtgacctgcatagggactatgaatgccctgagggttgaggcagttatttctgccctaagcaatttttacttacttccatgagctcagactgttggtattcagatacctgagcttctccttcacccttgacatttctctcctggttcactcttattcttttacttttttggcaagactgtcattatagacatcaatcagtaacattttagacgtcataactggatctcacatcggatttatgcttatgaaacctctctacttgtaattgtttcatttttgtctacctaacatcttgacattgacaagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagaggttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 3946 - DNA, 1403 bp, Homo sapiens
  ENST00000340329
agtaagttctcgcgagaggtagttggttgctatagttgtcaaaaacataactgaggctgctgcagagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaatggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 3947 - DNA, 3691 bp, Homo sapiens
  ENST00000355577
agcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaagactgatgaagaagctcagctttcgtttcatggtgtggcttatgttaatatggtcccattgttgtatccaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaagtgagtgactaccacatacagatcaagaatatttctagagccattctagatgaatactacagaatgtttggaaaacaggtggccaaactggagagtgatatggatagtgaaaccttggaggagcagaagtgccagctcagctatgaacttaattgctctggaaaatactttgctttcaaagaacaactcaagcatgctgtggtaaagattgtgagagataaatacttgaagacaacatcatttgaaagccaggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 3948 - DNA, 3703 bp, Homo sapiens
  ENST00000310715
agctcagcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaagactgatgaagaagctcagctttcgtttcatggtgtggcttatgttaatatggtcccattgttgtatccaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaaggcaatgagtgactaccacatacagatcaagaatatttctagagccattctagatgaatactacagaatgtttggaaaacaggtggccaaactggagagtgatatggatagtgaaaccttggaggagcagaagtgccagctcagctatgaacttaattgctctggaaaatactttgctttcaaagaacaactcaagcatgctgtggtaaagattgtgagagataaatacttgaagacaacatcatttgaaagccaggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaattc

SEQ ID NO: 3949 - DNA, 1222 bp, Homo sapiens
  ENST00000394865
tggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcaggtcagagttgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactc

SEQ ID NO: 3950 - DNA, 5247 bp, Homo sapiens
  ENST00000493964
gttgccatggagctgcccgccccaaaccacgccgccggcgccgcggagggcaatcgccaaggaccgccgcctgcctgagcagcccggggtgtctgtgcctccggagcccgagaacctgggacccaggccagccagagctaatttctatctcccagcatggaggatgacggcagcctgctccctgaggacgagcttttggccgatgcccttcttttggaagatgaaagagatgaattagaggatccggagtttgacatcaaatgtcttctacaggaagctgaggatgacgtggacccgggacacagcagctcagtgaaagaactagatactgatgctgataaattgaagaagaaaacagctgaggacagaacgcaggcatttcacctgcggcagaacctgagcgccctggataagatgcatgaggagcaagagcttttcactgagaagatgagaggggagctgcgcgcctgtcggcagaggcgggacctgatcgacaagcagcaggaggctgtggcagccgagatcgccacagaggaagaggcgggcaacatggccgctgtgggccgcctccaggccgtgtccagacgcctgtttgcagagctggagaacgagagagacctgcagtcgaggactgaggccgtgctgaaggagagcgagaacaccatgtggcacatcgagatccaggaggggcgactcgaggccttccggacagctgaccgtgaggaggtggaggccacggggcggcggctccaggtgcgcgcagccgagcagctctgcagagagcaggaggccctggggaaggtggagcggaaccgactgctgaggatcaggaagtccctgaacacccagaaggagctcgggctcaggcaccagaagctgctggaggacgcccggaagaaccacaaggttgccgtgcggttcctgaaggcctccctgggaagaatccgagagcaagagaagaaggaggagatggagtgccacgagtacatgaggcgacgcatggatgcggtggtggcgctgaagggcagcatctccgcgaaccgggacacactgcggaagttccaagcatgggaccgtgccaaggcagagctggcggagcagagggtccaggctgagaagaaggcgattctggcccagggcagggatgcattcaggcaccttgtccaccagcgccggcgccaggagctggaggcccagaagagggcctttgaggaggagcagaagctcagaaagcaggagatcatcagtcggattctgaaagaggaggctgaggaggaaaagaggaagaaacagcatccccccaccagtgccaggcaccggctgaccctgagggacaagacctggaactacatttctgacttttgcaagaagaccacagtcccaaccaacacgtacacactggactacgaggctgctgcaggccccgggccctctcggttgctggaagtcgtttccagtgagcttatccagggggaccccggggccagctcagaggaggaaacgttagctgagcccgagatctctgggctttggaatgaagactacaagccataccaggtgcccaaggaggacgtggaccgaaagcccgtgggcgggacaaagatggacaaggacatcctggagcgcacggtggagcggctgcggagcagggtggtccacaagcaggtggtgtgggggcgtgagttccaaggacgccccttcaacagcaaaccggagctcctccacttccaggactttgatattggcaaagtgtacaagaaaaagatcacgttggtaaacaccacctacacgatcaactactgcaagctggtgggcgtggaggagcacctccgggacttcatccacgttgactttgacccccctggccccctgtcagccggaatgtcctgtgaagtgcttgtcaccttcaagccgatgataaacaaggatctagaaggaaatatctcatttttggctcagacgggcgagttttcagttccactgaaatgttcaacaaagaaatgttcgctgtccctcgacaaggagctcattgacttcggcagctacgtggtaggagagaccacgtctcggaccatcacgctgaccaacgttgggggcttgggcacgactttcaagttcctgccagcttcagagccctgtgagatggacgactcccagtctgccctgaaattaagcagtctcctgacctacgaagataaaagcttgtatgacaaagccgccaccagcttctctgagcagcagctagagggcacggagtcctcccaggcggacatgcagagccggaaggagctggagaagctggacaaggagcaggaggaggagcagcccgcagaaccagagagattaaccacagtgatacctcccagcgaagagcagacggagatcacgctgggggaggtaacagaaggggaaattggccccttcagctccatcaaggtgcccatcgtcttcactccggtcgtcccaggcgacgtccaagccaggttcaaagtcacgtttaagaacccccagtgccccacgctgcatttcagggtcgtgggcgtggccatcgatgtgccggtctgggtgccgaagcccagcgtggacctgaagatctgcatgtatgaccggctctaccaggactctgtgctcgtgcacacgcggtcgaaagctgccctgcgcctgaagttcgaggtgtgcaaggagctgagggcccacctggagctcctgcccaagacaggctatatccaggcacagtcgtcctactccgtgcagctcaagttcctgccgcgacactccctcccggaggacgcagggaggtattttgacaaggagacccgagtcctggaggccccgatgaccatatgggttgccgaccagaacaagccagtgggattcaccgtgcatgccattgtcaccacctcggacctggagctcagtccctcggaggtggattttggctactgcaccatctatgaggccatcaggacggaaatcagcctccacaaccactcgctcctgccccaggagttcgggttcgtcaggcttcccaagtttgtggacgtccaacccaacgatgggtttgggacgatcctgcccctggaaacgctgcagttctgtgtgatcttccagcccaccaaggccgaggaacacagattccaactgacctgcaagtctgagatcaaccggtgcttcaagctgtcttgccgggctgtaggcgtccacccacccctggagctgtcccactaccagatcaagtttgccgccacggccctatacgacacctccgtggctacagtgtacgtcatcaactctcacctgagcatgagctcaccgacccactccaagccccgcattggctcagaggacgcctctcccatggggcccacgtctttcgagttcctgctgcccccagactcgcctatcaccatctcgccctcagtggggaccgtgtggccaggaaagaggtgcctggtccaggtggccttccggccagtgctgcccgagaagctgatccgccaggaagccctcccactcctgaacaaagaaatggagaccaaatctttccgaaagaatatggccccccagaggaaggacctgcatggactgtcattctccgttcttcgagcacagaaccgcgacaagctgttcaaagtctctgtcccccacgtcctggagatgcggaagcgggagctgaggcccagttccgacgagtaccaggccgcccgagccaccctgctcagagcgttccaggcgaagtttgacacatttgtagttccctgtgttgttgccagtggcgacatcaaagacaggaaggggtcagaacccctgagcttcagcccccacaacaccctgtacctggagctgtggtgcccgacggtggcaccatctgttgtggtgacgtcccataaaggcaagaccatctttaacttcggcgacgtcgctgtggggcaccgcagtatcaagaagatctccatccagaacgtctctcccgaggatctggccctggacttctccctgctgaaccccaacggcccctttgtcctgctgaaccactccagcctgctgcgtgcaggtgggacccaggtcctggtgctttccttctctccccacgagagcatcctggctcaagaaacactggacatcatcaccaagagaggcacgctcaccctcaccctcatgggcactggcgtggcgtccatgatcacgtgctccattgaaggcagcgtcctcaacatgggctatgtgattgccggagagtctgtgtcctcaggcttcaagctgcagaacaactctctgctccccatcaagttctccatgcacctggacagcctctccagcacccggggccggggccagcagcagctgccgcagttcctcagctcgccctcccagaggacggaggtggtcgggacgcagaatctcaacggtcagagcgtgttcagcgtggcccccgtcaagggcgtcatggaccccgggaagacacaagacttcactgtcaccttcagccccgaccacgaaagcctctacttctccgacaagctccaggtggtgctctttgaaaagaaaatctcccaccagatcctgctgaagggtgccgcctgtcagcacatgatgttcgtggagggcggcgaccccctggacgtgcccgtggagtctctgacagcgatccctgtatttgaccccaggcacagagaggaagctgaggagctgaggcccatcctggtgaccctggactacatccagtttgacacagacacgccagccccacctgccacccgagagctgcaggtgggctgtatccggaccacccagccatctccaaagaagccagaccacccactcatggtgtcggccctgctgcagctaaggggggatgtgaaggagacctacaaggtcatctttgtagcccaggtgttgactggcccctaagcctctgcacagagcaccctcgggccctcctgtccaccctcaaagccctccccaggctgagggccaggtcatactaccctagagcctgggacctggccatcctctgccagattccaataggccgccctccacatggcgccacggccacttcctgctgccctggaccccgcaagcccagggacatccaagagcacccctcctgagaccccagactcagaagcagcgagaaggccaggccagccctcagccatcctagccagaccccctcagagcccccagcccccaggagagccctccacagcctgtcaataaattttttgtaggccaacacatgca

SEQ ID NO: 3951 - DNA, 2756 bp, Homo sapiens
  ENST00000464311
gggtctgtgtgcccctccgcactggctactgtcttcctcgggcgccggtcggcttttgcgtccccacattcaatcccaactgcggctcccgcggttcccgcactggccgcagaggagccacggggcacagctggctgtgtttagggccctgcacagccccacagccagtcgctccccccacagttccgaaagaatatggccccccagaggaaggacctgcatggactgtcattctccgttcttcgagcacagaaccgcgacaagctgttcaaagtctctgtcccccacgtcctggagatgcggaagcgggagctgaggcccaggtgggtccaggaggggctgccccacctgcttccctccaggcccctctggtgggacccactgtggcccctgtagagtcccctccctacagattgcccggaatgacccatgtggctggaaggactgatgccttcagacacagctggatccaggtgctgccttcctgggacctacccaccccatttccccaggcctgacacccctgcacacagcctcaatccacgggtggggagcaaagccaccaccccccacccagccccccgggtgcagaatgagccctgggaaagctctaatgggtgcctgtggccccgggaaggaacatggctctctagccaggggccaaaggcacctgccccaacccctagcctccagccaccagctgacgaggacctgaagtgagtgatgagacccccacaggagccagagaagggtggaaaagccagtttgtcagacacaactgggacagccacagcttgggaccctgggaccctgggaccctgaggcagagccgcaggggtccggcctgggccgatggtgggtgggggcaaggcgggagcgcaagcctctgacttccttctagttccgacgagtaccaggccgcccgagccaccctgctcagagcgttccaggcgaagtttgacacatttgtagttccctgtgttgttgccagtggcgacatcaaagacaggaaggggtcagaacccctgagcttcaggtgcggggtgctctggccagaacagggtgtggtcagccgcaaacgcgctgtccctctgctactgcccaactctggggcctgggcgggcagggggccgcccaccctgccctcagcatgcccttcctatcccagcccccacaacaccctgtacctggagctgtggtgcccgacggtggcaccatctgttgtggtgacgtcccataaaggcaagaccatctttaacttcggcgacgtcgctgtggggcaccgcagtatcaagaagatctccatccagaacgtctctcccgaggatctggccctggacttctccctgctgaaccccaacggcccctttgtcctgctgaaccactccagcctgctgcgtgcaggtgggacccaggtcctggtgctttccttctctccccacgagagcatcctggctcaagaaacactggacatcatcaccaagagaggcacgctcaccctcaccctcatgggcactggcgtggcgtccatgatcacgtgctccattgaaggcagcgtcctcaacatgggctatgtgattgccggagagtctgtgtcctcaggcttcaagctgcagaacaactctctgctccccatcaagttctccatgcacctggacagcctctccagcacccggggccggggccagcagcagctgccgcagttcctcagctcgccctcccagaggacggaggtggtcgggacgcagaatctcaacggtcagagcgtgttcagcgtggcccccgtcaagggcgtcatggaccccgggaagacacaagacttcactgtcaccttcagccccgaccacgaaagcctctacttctccgacaagctccaggtggtgctctttgaaaagaaaatctcccaccagatcctgctgaagggtgccgcctgtcagcacatgatgttcgtggagggcggcgaccccctggacgtgcccgtggagtctctgacagcgatccctgtatttgaccccaggcacagagaggccagctcccggccaggccctctctctccagaagctgaggagctgaggcccatcctggtgaccctggactacatccagtttgacacagacacgccagccccacctgccacccgagagctgcaggtgggctgtatccggaccacccagccatctccaaagaagaccgttgagttcagcatagacagcgtcgcatccctgcagcacaagggtttctctattgagccctccaggggctccgtggagcgcggccagacgaagaccatcagcatctcctgggtgccacctgcggactttgatccagaccacccactcatggtgtcggccctgctgcagctaaggggggatgtgaaggagacctacaaggtcatctttgtagcccaggtgttgactggcccctaagcctctgcacagagcaccctcgggccctcctgtccaccctcaaagccctccccaggctgagggccaggtcatactaccctagagcctgggacctggccatcctctgccagattccaataggccgccctccacatggcgccacggccacttcctgctgccctggaccccgcaagcccagggacatccaagagcacccctcctgagaccccagactcagaagcagcgagaaggccaggccagccctcagccatcctagccagaccccctcagagcccccagcccccaggagagccctccacagcctgtcaataaattttttgtaggccaaca

SEQ ID NO: 3952 - DNA, 1972 bp, Homo sapiens
  ENST00000412120
cacacagcctcaatccacgggtggggagcaaagccaccaccccccacccagccccccgggtgcagaatgagccctgggaaagctctaatgggtgcctgtggccccgggaaggaacatggctctctagccaggggccaaaggcacctgccccaacccctagcctccagccaccagctgacgaggacctgaagtgagtgatgagacccccacaggagccagagaagggtggaaaagccagtttgtcagacacaactgggacagccacagcttgggaccctgggaccctgggaccctgaggcagagccgcaggggtccggcctgggccgatggtgggtgggggcaaggcgggagcgcaagcctctgacttccttctagttccgacgagtaccaggccgcccgagccaccctgctcagagcgttccaggcgaagtttgacacatttgtagttccctgtgttgttgccagtggcgacatcaaagacaggaaggggtcagaacccctgagcttcagcccccacaacaccctgtacctggagctgtggtgcccgacggtggcaccatctgttgtggtgacgtcccataaaggcaagaccatctttaacttcggcgacgtcgctgtggggcaccgcagtatcaagaagatctccatccagaacgtctctcccgaggatctggccctggacttctccctgctgaaccccaacggcccctttgtcctgctgaaccactccagcctgctgcgtgcaggtgggacccaggtcctggtgctttccttctctccccacgagagcatcctggctcaagaaacactggacatcatcaccaagagaggcacgctcaccctcaccctcatgggcactggcgtggcgtccatgatcacgtgctccattgaaggcagcgtcctcaacatgggctatgtgattgccggagagtctgtgtcctcaggcttcaagctgcagaacaactctctgctccccatcaagttctccatgcacctggacagcctctccagcacccggggccggggccagcagcagctgccgcagttcctcagctcgccctcccagaggacggaggtggtcgggacgcagaatctcaacggtcagagcgtgttcagcgtggcccccgtcaagggcgtcatggaccccgggaagacacaagacttcactgtcaccttcagccccgaccacgaaagcctctacttctccgacaagctccaggtggtgctctttgaaaagaaaatctcccaccagatcctgctgaagggtgccgcctgtcagcacatgatgttcgtggagggcggcgaccccctggacgtgcccgtggagtctctgacagcgatccctgtatttgaccccaggcacagagaggccagctcccggccaggccctctctctccagaagctgaggagctgaggcccatcctggtgaccctggactacatccagtttgacacagacacgccagccccacctgccacccgagagctgcaggtgggctgtatccggaccacccagccatctccaaagaagaccgttgagttcagcatagacagcgtcgcatccctgcagcacaagggtttctctattgagccctccaggggctccgtggagcgcggccagacgaagaccatcagcatctcctgggtgccacctgcggactttgatccagaccacccactcatggtgtcggccctgctgcagctaaggggggatgtgaaggagacctacaaggtcatctttgtagcccaggtgttgactggcccctaagcctctgcacagagcaccctcgggccctcctgtccaccctcaaagccctccccaggctgagggccaggtcatactaccctagagcctgggacctggccatcctctgccagattccaataggccgccctccacatggcgccacggccacttcctgctgccctggaccccgcaagcccagggacatccaagagcacccctcctgag

SEQ ID NO: 3953 - DNA, 550 bp, Homo sapiens
  ENST00000493316
ctgtgctctgggtggtgaggcgagcgtctgccctccgcagcactaacccccgtgtgctatgggtcacgtcctgcagctttgacccccctggccccctgtcagccggaatgtcctgtgaagtgcttgtcaccttcaagccgatgataaacaaggatctagaaggaaatatctcatttttggctcagacgggcgagttttcagttccactgaaatgttcaacaaagaaatgttcgagcagtctcctgacctacgaagataaaagcttgtatgacaaagccgccaccagcttctctgagcagcagctagagggcacggagtcctcccaggcggacatgcagagccggaaggagctggagaagctggacaaggagcaggaggaggagcagcccgcagaaccagagagattaaccacagtgatacctcccagcgaagagcagacggagatcacgctgggggaggtaacagaaggggaaattggccccttcagctccatcaaggtgcccatcgtcttcactccggtcgtcccaggcgacgtccaagccaggttcaa

SEQ ID NO: 3954 - DNA, 4710 bp, Homo sapiens
  ENST00000270720
gttgccatggagctgcccgccccaaaccacgccgccggcgccgcggagggcaatcgccaaggaccgccgcctgcctgagcagcccggggtgtctgtgcctccggagcccgagaacctgggacccaggccagccagagctaatttctatctcccagcatggaggatgacggcagcctgctccctgaggacgagcttttggccgatgcccttcttttggaagatgaaagagatgaattagaggatccggagtttgacatcaaatgtcttctacaggaagctgaggatgacgtggacccgggacacagcagctcagtgaaagaactagatactgatgctgataaattgaagaagaaaacagctgaggacagaacgcaggcatttcacctgcggcagaacctgagcgccctggataagatgcatgaggagcaagagcttttcactgagaagatgagaggggagctgcgcgcctgtcggcagaggcgggacctgatcgacaagcagcaggaggctgtggcagccgagatcgccacagaggaagaggcgggcaacatggccgctgtgggccgcctccaggccgtgtccagacgcctgtttgcagagctggagaacgagagagacctgcagtcgaggactgaggccgtgctgaaggagagcgagaacaccatgtggcacatcgagatccaggaggggcgactcgaggccttccggacagctgaccgtgaggaggtggaggccacggggcggcggctccaggtgcgcgcagccgagcagctctgcagagagcaggaggccctggggaaggtggagcggaaccgactgctgaggatcaggaagtccctgaacacccagaaggagctcgggctcaggcaccagaagctgctggaggacgcccggaagaaccacaaggttgccgtgcggttcctgaaggcctccctgggaagaatccgagagcaagagaagaaggaggagatggagtgccacgagtacatgaggcgacgcatggatgcggtggtggcgctgaagggcagcatctccgcgaaccgggacacactgcggaagttccaagcatgggaccgtgccaaggcagagctggcggagcagagggtccaggctgagaagaaggcgattctggcccagggcagggatgcattcaggcaccttgtccaccagcgccggcgccaggagctggaggcccagaagagggcctttgaggaggagcagaagctcagaaagcaggagatcatcagtcggattctgaaagaggaggctgaggaggaaaagaggaagaaacagcatccccccaccagtgccaggcaccggctgaccctgagggacaagacctggaactacatttctgacttttgcaagaagaccacagtcccaaccaacacgtacacactggactacgaggctgctgcaggccccgggccctctcggttgctggaagtcgtttccagtgagcttatccagggggaccccggggccagctcagaggaggaaacgttagctgagcccgagatctctgggctttggaatgaagactacaagccataccaggtgcccaaggaggacgtggaccgaaagcccgtgggcgggacaaagatggacaaggacatcctggagcgcacggtggagcggctgcggagcagggtggtccacaagcaggtggtgtgggggcgtgagttccaaggacgccccttcaacagcaaaccggagctcctccacttccaggactttgatattggcaaagtgtacaagaaaaagatcacgttggtaaacaccacctacacgatcaactactgcaagctggtgggcgtggaggagcacctccgggacttcatccacgttgactttgacccccctggccccctgtcagccggaatgtcctgtgaagtgcttgtcaccttcaagccgatgataaacaaggatctagaaggaaatatctcatttttggctcagacgggcgagttttcagttccactgaaatgttcaacaaagaaatgttcgctgtccctcgacaaggagctcattgacttcggcagctacgtggtaggagagaccacgtctcggaccatcacgctgaccaacgttgggggcttgggcacgactttcaagttcctgccagcttcagagccctgtgagatggacgactcccagtctgccctgaaattaagcagtctcctgacctacgaagataaaagcttgtatgacaaagccgccaccagcttctctgagcagcagctagagggcacggagtcctcccaggcggacatgcagagccggaaggagctggagaagctggacaaggagcaggaggaggagcagcccgcaggtgagccaggctgccaggccaagccagggtgggcgggcggtgagggcctcagggcagcattccagggggctgaggggcccaggggagggctggaaagtagagaattttcctaggccttcgatgttaagtgacggttaagcaagaaaatattcttatgtgccactaagtgttgtttttggagtggacgaaaatgtacattcacgttgacgctaaccgaagacttgaaggcacctccagcattggcccagcaggcccagcacgggcggagccgcacagggcggggaagaggctctgcggtgccccctggaggggccgggctgcggggggcttctgtctagctctgcagctgtggctgttgttagacgcgcaccagcggggagaggtgccgagaaacgggcgggccctgccctccccatgcctcctgccctgcagcccgccgccatcgggaatcgcttgcgtctcctccttgcttctcttgatcgttttcccacatacgcatcgagatccagaaacctccgtcctcctcctgtctgtcttcgcgtggtgcgcgttccgcacgccctgcagctcagcgcggagctgggccggttctccacagcctgtgtgagccgcacttccggtgtgagccgcacttccggtgtgagccgcacttccggtgtgagccgcacttcctgtcctcaccactgcgtggcgtttcctttcctgagagagcctcgggttctagatccgtccttctgccagtgcacacttgggagcgttcgtggtacacactgttgcgaaggccgttctgcactgccccttggcctgtgtgtgagttcccacagggcacctggctggggctcatgcctgcatcacagggcatagccagcctcactggcatcagctaataccaaagtgagttctttttatgttgagacagggtctctgtcgcctaggctggagtgcagtggtgcagtcacagctcactgcagcctcgacctcccgggctcaagcaatcctcctgcctcagctcctgagtagctggaactacaggcacgcaccaccgcacctggctagtttttgtatttttttgtagacacagggtttcgccatgtttcccaggctggtgtggaactcctgaactcaggctgtctgcccacctcagcctcccaaggtgctggattacaggcatgagccacctcgcctagcccaccgagttctttttcaaagtggttgtgcaagtttacactcccaccaacagtgtacaagactgtgctgtccagcgtggctgtcactgccacatctggctatttaaacttaaattgatccaaattaaataatagtgaaaattcaggtcctcctccacaagggccacatttcacatgctccatagcgacctgtgggcaacggctgccctactggacagcccagaagcccagctctgcctggtcacagagggtcctacggggccacactgggcttgagggccttgcttcacatccgcaggagcacgaggtcacacggcccggggctgcttgtctggggggcctgcaccacggtctgctgttgagatgttgctttttggtttcccagatcaccagtgagattgcgtgtctttccctgggcccatttacaagttgtatcttctttggtgtgacatctctgtttaaggctatcccttgttcttctgtgggattgtctgtcttcttctcattcattcataggagctcttcatgcacccagattccagccctcctccctgaggaatgttgcaggtgctgcctccgagtctgtggctgggccttcctctccctttatgacgtcttttctcaaatcaaagttcttcagtccagtctttgcatatttaccagtcatttctattggaatttgttttttatgatttttaggcaatttttttctcctccagggtcataaagacataggacatcgcttttgtgttgaggtgtatgatccacctcaaattcactcctgcttgtggtggaagtcagggctgaggctcatttcccctggtgcgtgtttgtgtattccacggcacaagtggactctgctatcccattcgatccattcgttgtccgtgtcaaaaatcaattgaccatccaggcacagtggctcatgcctgtaatcccagaactttgggaggccgaggcaggaggatcacttgaggtcaagagtttgagaccagcctggccaacatggtgaaaccccatttctactaaaaatacaaaaaattagccaggcgtggtggcgggcgcctgtaatcccagctacttgggtggctgaggcaagagaattgcttgaacccgggaggcggaggttgcagtgagctgagatcgcgccattgcactccagcctggcctataagagtaaaatactgtctc

SEQ ID NO: 3955 - DNA, 2585 bp, Homo sapiens
  ENST00000468610
caggccagccagagctaatttctatctcccagcatggaggatgacggcagcctgctccctgaggacgagcttttggccgatgcccttcttttggaagatgaaagagatgaattagaggatccggagtttgacatcaaatgtcttctacaggaagctgaggatgacgtggacccgggacacagcagctcagtgaaagaactagatactgatgctgataaattgaagaagaaaacagctgaggacagaacgcaggcatttcacctgcggcagaacctgagcgccctggataagatgcatgaggagcaagagcttttcactgagaagatgagaggggagctgcgcgcctgtcggcagaggcgggacctgatcgacaagcagcaggaggctgtggcagccgagatcgccacagaggaagaggcgggcaacatggccgctgtgggccgcctccaggccgtgtccagacgcctgtttgcagagctggagaacgagagagacctgcagtcgaggactgaggccgtgctgaaggagagcgagaacaccatgtggcacatcgagatccaggaggggcgactcgaggccttccggacagctgaccgtgaggaggtggaggccacggggcggcggctccaggtgcgcgcagccgagcagctctgcagagagcaggaggccctggggaaggtggagcggaaccgactgctgaggatcaggaagtccctgaacacccagaaggagctcgggctcaggcaccagaagctgctggaggacgcccggaagaaccacaaggttgccgtgcggttcctgaaggcctccctgggaagaatccgagagcaagagaagaaggaggagatggagtgccacgagtacatgaggcgacgcatggatgcggtggtggcgctgaagggcagcatctccgcgaaccgggacacactgcggaagttccaagcatgggaccgtgccaaggcagagctggcggagcagagggtccaggctgagaagaaggcgattctggcccagggcagggatgcattcaggcaccttgtccaccagcgccggcgccaggagctggaggcccagaagagggcctttgaggaggagcagaagctcagaaagcaggagatcatcagtcggattctgaaagaggaggctgaggaggaaaagaggaagaaacagcatccccccaccagtgccaggcaccggctgaccctgagggacaagacctggaactacatttctgacttttgcaagaagaccacagtcccaaccaacacgtacacactggactacgaggctgctgcaggccccgggccctctcggttgctggaagtcgtttccagtgagcttatccagggggaccccggggccagctcagaggaggaaacgttagctgagcccgagatctctgggctttggaatgaagactacaagccataccaggtgcccaaggaggacgtggaccgaaagcccgtgggcgggacaaagatggacaaggacatcctggagcgcacggtggagcggctgcggagcagggtggtccacaagcaggtggtgtgggggcgtgagttccaaggacgccccttcaacagcaaaccggagctcctccacttccaggactttgatattggcaaagtgtacaagaaaaagatcacgttggtaaacaccacctacacgatcaactactgcaagctggtgggcgtggaggagcacctccgggacttcatccacgttgactttgacccccctggccccctgtcagccggaatgtcctgtgaagtgcttgtcaccttcaagccgatgataaacaaggatctagaaggaaatatctcatttttggctcagacgggcgagttttcagttccactgaaatgttcaacaaagaaatgttcgctgtccctcgacaaggagctcattgacttcggcagctacgtggtaggagagaccacgtctcggaccatcacgctgaccaacgttgggggcttgggcacgactttcaagttcctgccagcttcagagccctgtgagatggacgactcccagtctgccctgaaattaagcagtctcctgacctacgaagataaaagcttgtatgacaaagccgccaccagcttctctgagcagcagctagagggcacggagtcctcccaggcggacatgcagagccggaaggagctggagaagctggacaaggagcaggaggaggagcagcccgcagtgttgtttttggagtggacgaaaatgtacattcacgttgacgctaaccgaagacttgaaggcacctccagcattggcccagcaggcccagcacgggcggagccgcacagggcggggaagaggctctgcggtgccccctggaggggccgggctgcggggggcttctgtctagctctgcagctgtggctgttgttagacgcgcaccagcggggagaggtgccgagaaacgggcgggccctgccctccccatgcctcctgccctgcagcccgccgccatcgggaatcgcttgcgtctcctccttgcttctcttgatcgttttcccacatacgcatcgagatccagaaacctccgtcctcctcctgtctgtcttcgcgtg

SEQ ID NO: 3956 - DNA, 540 bp, Homo sapiens
  ENST00000461752
gactgtgctctgggtggtgaggcgagcgtctgccctccgcagcactaacccccgtgtgctatgggtcacgtcctgcagctttgacccccctggccccctgtcagccggaatgtcctgtgaagtgcttgtcaccttcaagccgatgataaacaaggatctagaaggaaatatctcatttttggctcagacgggcgagttttcagttccactgaaatgttcaacaaagaaatgttcgctgtccctcgacaaggagctcattgacttcggcagctacgtggtaggagagaccacgtctcggaccatcacgctgaccaacgttgggggcttgggcacgactttcaagttcctgccagcttcagagccctgtgagatggacgactcccagtctgccctgaaattaagcagtctcctgacctacgaagataaaagcttgtatgacaaagccgccaccagcttctctgagcagcagctagagggcacggagtcctcccaggcggacatgcagagccggaaggagctggagaagctggacaaggagca

SEQ ID NO: 3957 - DNA, 2145 bp, Homo sapiens
  ENST00000378592
gttgccatggagctgcccgccccaaaccacgccgccggcgccgcggagggcaatcgccaaggaccgccgcctgcctgagcagcccggggtgtctgtgcctccggagcccgagaacctgggacccaggccagccagagctaatttctatctcccagcatggaggatgacggcagcctgctccctgaggacgagcttttggccgatgcccttcttttggaagatgaaagagatgaattagaggatccggagtttgacatcaaatgtcttctacaggaagctgaggatgacgtggacccgggacacagcagctcagtgaaagaactagatactgatgctgataaattgaagaagaaaacagctgaggacagaacgcaggcatttcacctgcggcagaacctgagcgccctggataagatgcatgaggagcaagagcttttcactgagaagatgagaggggagctgcgcgcctgtcggcagaggcgggacctgatcgacaagcagcaggaggctgtggcagccgagatcgccacagaggaagaggcgggcaacatggccgctgtgggccgcctccaggccgtgtccagacgcctgtttgcagagctggagaacgagagagacctgcagtcgaggactgaggccgtgctgaaggagagcgagtgagtcggtgtgcagccgggactggcagcaggcaggccccagaacgaacagcgagctgggttttcaaagcccaggagagagacagctgcctcgtcctaaatgctttcctgtggagttgggttggatgcgtcgagttgccttcggcgagtttggcaagaaggggtttgggaaggtgcacgaatttctcagggcgactgaggggaccctgagctgacctcaagtaggactcccgaaccacacagcccccagccccgggagctgcagccaggtccatgacatccacagcactgaccctgcacgtgcccgggatgacctaagctttccagcctgggcagggcaggaggcacagagagggctgagtgcaggcctcaggccaccccacccctaagagtgcccatgccgccagccctcatgcaacctaacatctcagcctcactccactgaagacaccactgagctttgacccagtctctgacctgcactcactgtgatgtagtcacgacccagtctctgacccacacttgctgtgacgtagtttctggcccagtctctgacccacgctcgctgtgatacagtcacgacccaagctggtgtccagtgccctgcactgtggccccacctgtgtgggcagtgggaggggtgcaggggaggacaggacgctgaacccagctgtggctgagcgtggagaacactgtcccctgcgacactcctttgacaactggctctgtcatgcccctctcactgctcagcagcacctgcgccagggtgaggggcttcacagggctaatgaaccccagaaggcctcactttactaggttgatgtgattgtccacttctttaaaaaaaaaaaaaaaaaaagtttttgggctgggcccagtggctcatgcctataatcccaacactttgggaggcccaggctggtggatcacctgaggtcaggagttcaagaccagcccaggcaacatagcgaaaccctgtctctactaaaaatacaaaaattaactgggcgtggtggtgcatgcctgtaatcccagctactcgggaggctgaggcaggagaatcgctggagcccagaggtagaggttgcagtgagccaagattgcgccactgccacactccagcctgggcgacagagtgagcaagactctgtcttttaaaaaaaaaaaaaatggctgggcgcggtggctcacgcctgtcatcccagcactttgggaggccgaggcgggtggatcacaaggtcaggagatcgagaccatcctggctaacacggtgaaacccccatctctactaaaaatacaaaaaattagccgggcgtgctggcaggcgcctgtagtcccagctactcggaaggctgaggcaggagaatggcgtgagcccgggaggcggagcttgcagtgagccaagattgcgtcactgcactccagcctgggcgacagagcgagactccgtctcaaaaataaataaataaataaagttttattttgaaac

SEQ ID NO: 3958 - DNA, 441 bp, Homo sapiens
  ENST00000378590
gaggacgagcttttggccgatgcccttcttttggaagatgaaagagatgaattagaggatccggagtttgacatcaaatgtcttctacaggaagctgaggatgacgtggacccgggacacagcagctcagtgaaagaactagatactgatgctgataaattgaagaagaaaacagctgaggacagaacgcaggcatttcacctgcggcagaacctgagcgccctggataagatgcatgaggagcaagagcttttcactgagaagatgagcgtctcctaaaaactaaaaacattcagcggagagtggtggcgcacgcctgtggtcccagtgacttgggaggctgaggccagaggatggcttgagcccaggaggtcaaggctgcagcaagcctgggtgacagagcaagaccctgtctctaaaaataaaaaactgaaagacaaa

SEQ ID NO: 3959 - DNA, 564 bp, Homo sapiens
  ENST00000505188
tgggatcagcatccctactttttgagaggctaactctgaggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccatt

SEQ ID NO: 3960 - DNA, 589 bp, Homo sapiens
  ENST00000502442
cgtcgggggacaacggagatattttctgcagaaagtgacgaaagagcattctggttcctgcagaggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccatt

SEQ ID NO: 3961 - DNA, 1138 bp, Homo sapiens
  ENST00000427934
agggagctccgaggacgagggggagggccggagctgcgcgtgctgctttgcccgagcccgagcccgagcccgagcccgagcccgagcccgagcccgaacgcaagcctgggagcgcggagcccggctaggacagagtcttactctattgcccaagctggagtgcagtggtgcaattacagctcactgcagcttcaacctcctgggctcaggtgatcctcctgcctcagcctcctaagtcgctgggactacaggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcag

SEQ ID NO: 3962 - DNA, 5091 bp, Homo sapiens
  ENST00000271636
gaggacgagggggagggccggagctgcgcgtgctgctttgcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaatcatcagcaataagctgatagatggactttccactgtaggagtggacatttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaa

SEQ ID NO: 3963 - DNA, 394 bp, Homo sapiens
  ENST00000416743
cacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaagga

SEQ ID NO: 3964 - DNA, 373 bp, Homo sapiens
  ENST00000464886
gacctcttccctctgagccttctggtgtccaactctccccttctctaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcag

SEQ ID NO: 3965 - DNA, 2956 bp, Homo sapiens
  ENST00000473377
agggcactgaggtgtgacctgtggaaaaagggtgggacttccaagcctctttctgtactagcggtcaaaaccgacagcccacagttgatgagttttgtttggctgcagtattttcaacaactttgaatcaattgccaatgtttagaaatttatagaggtcacctaaaaatttggatttctagtttcttttgtatttggcagatatggtaatactgagtgtcttgtcctgagtctgcatggcaacagttggctggagctgagcagtgggtttcccctttagagtgaacagtattcttcagtttgctatatttgataataataatagcagcagcaaacatattgtgctgtgtgataggcacttaagacttaatcctcagaataactctgtggggtaggtagtcttgttttctccattttacagatgaaggaaactgaggcacagagagatgaacttgtccatggtctactgccaggaagtggtaaatctgattttcagactggacagtctggtcccatgtacatactcttagcctctacgtggtactgcctccagtacctcagtttctgagtctcttcacctcagccttggcccaggtacttgggtttctctctcttttcccattagagaaataaggttttccaatgaagagtagattctggggtttgcctttctgtcaaagggccgtcaccagagcatggccccgacctgcccatgatgccacatctggtcagtagagggcgctggctccatagtggctctgggtccaggcaagtaccaaaaggttactgggatgtgcaagagagaaaagtctgttaatgctggagtttgagaggctcctggtctgagtttggcattctggtgtccagcatttgggacagaattacttgttcttctgtcctaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaatcatcagcaataagctgatagatggactttccactgtaggagtggacatttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaa

SEQ ID NO: 3966 - DNA, 930 bp, Homo sapiens
  ENST00000467998
gcggctacaggctgaagagaggtgacataagcctatccttcctcccttcctccctccttttcttcctccctccctcttggcttttctcctctgtggctccctccatcttccacctcagatatggccagcctggcctgatctttagggaacactttctcctgatagagagcaaagagtgttgcagaaattctgaaatgtgaatgacgtcactctccctcattctttgaatctgccctggatcctgcccagtctaatggtggagctcatggctgagaggagtccttggggacagtagggggccaagttaggattcccttagaaatggggacactcatagacattcttctacctcaccttagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaa

SEQ ID NO: 3967 - DNA, 7224 bp, Homo sapiens
  ENST00000281282
gcactccggccgggctctgctggctgcggcgggagctggacgcgggaggaggcggcggcggcgctggaacagtgaaccatggagctgtatttcggtgaatatcaacatgtgcagcaggaatatggggtccatctgagactcgcaagtgatgatacccaaaaatcaaggagttcccagaactccaaggcaggctcctacggtgtcagtattcgggtccagggaattgatggtcacccctatattgtcctgaataacacagaacggtgcctagcaggcacatcgttttctgaaaatgggccaccctttccacctccagtgataaataacctgcctctacattccagcaatggttctgtgccaaaggagaacagtgaagaacttcagcttccagaaaacccatacgcccagcctagcccaataagaaacctgaaacagcccctgctccatgagggcaagaatggagttctagatcgcaaagacgggtctgtgaagccatctcacctgctgaactttcagaggcatccagagcttttgcaaccctatgaccctgaaaagaatgagttgaatttacaaaatcaccagccttctgagagtaattggctaaaaacgttgacagaagaaggcatcaacaataagaagccttggacttgctttcccaaacctagcaattcccagcctaccagtccctccttggaagacccggccaaatctggtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatacagatgacaggaaaagatccagaagcgtggatagcgcctttccttttggcctccaagggaactcggagtacctgattgaattcagtaggaacttgggcaagtcaagcgaacacctcctccggccttcccaggtgtgcccgcagcggccactgtctcaggagcgccgtgggaaacagagcgtgggccgcacctttgcaaagctgcagggagcagcgcacggggcttcatgtgcccactccaggcctccccagccgaacatagatgggaaagttctggaaaccgaaggtagtcaggaaagtacagtgatccgtgcgccctcccttggtgcacagagtaaaaaggaggaggaggtgaaaacagccaccgctacgctgatgttacagaaccgggcaacagcaacttcgcctgattctggtgccaagaaaatttccgtgaagacatttccttcggcctcaaatactcaggccacaccggatctcttaaagggccagcaagagctcactcagcaaaccaatgaggagacagctaagcagattctctacaattacctcaaagaaggaagcactgataatgacgatgctactaaaaggaaagtcaacttggtctttgagaaaatccagaccttaaagtctcgagcagctgggagcgcccaaggaaataaccaagcttgtaattccacatctgaagtcaaagatctattggaacagaaaagcaagttgaccatagaagtggctgaacttcagagacagcttcaactggaagtcaagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagctattccaggtgaagatggaacgggagcagcatcagactgagatcagggatctccaggaccagctctcagaaatgcacgatgaactggacagtgcaaagcgatcggaggacagggagaagggagctctgattgaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaagaatgtcgaggtcttggcgagcaggagcaacacttcagagcaagaccaggcggggactgaaatgcgcgtgaagcttctgcaggaggagaatgagaagctgcagggaagaagcgaagagctggagcggagagttgctcagcttcaaaggcagatcgaggacctgaaaggcgatgaagccaaggcgaaggaaacgctgaagaagtacgagggagaaatacgacagttagaggaggcccttgtgcacgccagaaaggaagaaaaagaagctgtgtcagccagaagggccctggagaatgaactggaggctgctcagggaaatctgagtcagactacccaggagcagaagcagttgtctgagaagctcaaagaggagagtgagcagaaggagcagctaagaaggttgaagaacgagatggagaatgagcggtggcacctgggcaaaaccattgagaaactgcagaaggagatggcagacattgttgaggcctcccgtacctcaaccctggagctccagaaccagctggatgagtataaggagaaaaaccgcagggagctcgcagaaatgcaaagacagttgaaggagaaaacgctggaggcagaaaagtcccgactgacagccatgaaaatgcaggatgagatgcgtctgatggaggaagagttacgggactaccagagagctcaggatgaagcactcacaaaaaggcagcttctggagcagacgctgaaggacctggagtatgagctggaagccaagagtcacctcaaagatgaccgcagcaggctggtcaagcagatggaggacaaggtgtctcaactggagatggaactggaagaagagagaaacaactcagatttgctgtctgagaggatcagtaggagcagggaacagatggagcagttgaggaatgagctacttcaggagagagctgcgagacaagacttggagtgcgacaagatttccctggagaggcagaacaaggacttaaagagccggattatccacctggaaggttcctacaggtccagcaaagaggggctggttgtgcagatggaggccaggatcgcggagctggaggaccgcctggagagtgaggagagggatcgggccaatcttcagctcagcaaccggcggctggagcggaaagtgaaggagctggtgatgcaggtggatgatgagcacctgtcattgactgatcagaaggaccagctgagcttgcgtttgaaagccatgaagcggcaggtggaggaggctgaggaggaaatcgacagactggaaagttctaaaaagaagctgcagagggagctggaggagcagatggacatgaatgagcatctgcaggggcagctcaactccatgaagaaggacttaagactgaagaagctgccgagtaaagtgctggatgacatggatgacgacgatgacctcagcacggatgggggaagcctctatgaggcgcctgtgagctacacattctccaaggacagcaccgtcgccagccagatctgagtgctctcccgggctgtggaagtacctgtcattcctgcaggagctgcagccacccaaagtgggaggcagggaggggagcatctgtctgccactgagaccaatcacagcctctttgcacagcatgccagctcctcagtgttacattcctcgccagggtctctcagtgggtcttcgacagagagcttttgcagtttaaaatgttgggatgcctgaggaccaggagccaccacccactggggtgttgtgagagatacactttggtaggctgaggcccctgttccacagccactatttgcattgctgtccctgccccctcatcactccccctgccaagacaaagggtccagaaggctaggacttacttaatagcactgtgcagggaggaaaccatgtatagcttgtacatattttaaaccagaccttctcacgaactgctgctgttgggtttggaatgtgatggaggcttggtagggtggctggtttgtaaagttcatgcatctatattgagtattctttttttttttttttgagatggagtttcattcttgttgccgaggctggagtgcaatggcgcaaccttggctcactgcaacctctgcctccctggttcaagtgattctcctgcctcatcctcccaagaagctgagattacagatgaccaccaccactcctggctaattttttgtatttagtagagacggggtttcaccatgttggtcaggctggtcttgaactcctgacctcaggtgatccacctgcctcagcctcccaaagtgctgagattacaggcatgagccaccacgcccagccattgagtattcttttttaaaatatgaagctattagattttaagtgttgaggagcagaggtgagaagagagagagagagagaaagtcaaataaagtcaaagaccagtttggaaaccaaagttggaaaagaagaattgtagtggtcatggacagctaagactgagcatagcagttcacatggtctgggtaaacaagtcactggcacaggggaaagccagaaggttgcttgtgtctgtgactgcagctatggccttgtttgcttagtttatctggaattctgttataatttctgaactgttctgagacctgttcccagtcactgattgcaatttcttttacacaggttgggtagggagagttgtaggtaaggccttaaacaaatgaggccgtttctggaaggatagggctgtgtggtcatgtcccacagcaagcttttgggatcgggggaataagagggtatgggggaaaggttcatagacttaggtgtgagaatgaggtgggaggtgtctggtaaggtcatgggggaagggagatgagagaggagataggcagatgtgggtatggggcccagtgtgagaaggaagacagagaagttcttgaaagctgggggatgtgtgggcaagaggtggattgagcaggatctcagggttatgtcgaggaagggaagaaagaaacagaagtcaggcagaggcgtgtctgtgcaaactggaggactccttccaacttcctggaacaaagcgacatcgccagcagcaggctggcagggagtggttgaggtctgggggccaggccacatggctggagaggaatttcagggagcatagcatcgggaggatgctacatatccagggactccctcctggccttcctgtgtcacttcacaatgtgacagtccccaggcatgcccacaggccaggcccagtcacagctgggcttccacaggtcagaatatgggacaggacatggtcagggagaggaccctgtgagttggtgacatatatgtggcagagatggtagtgttcagctgcttcagcagtgtccccaaccatcccaatagggtgggggcctgtgggccagaggactccatgacagtagccatggagtcccacctgtgccaggtcagagcccacccggcaggtttcagagtggtcagcccagtttaagggtgggagtctggagccagacagccaagccccttccacatctacagggtcactgtcatcctcaccacagccaggggtgattctcacctctgcctgcttatgtggggtgtggccgattcctccctttagtcattcattcatttagcacatatttattgggcatcggtgatgtgtcaggcacagtccttggcacacagaatacagcagtgaattaaacaggcaaaaattcctcccctcctggagctcagtgtcaggaaagggggtgataaatgacaatcaaatcgacatggaggttgagcacctctgtactcagccctctgtctgtccttctgaggacgcaacaagcctggttccctagagctcactttgaccctcaatatgttcataatttccctgctgcttctcccatcgttagacatctgccagtaagcctgctgagagaagcctcagcccactcatacctagagacgctgctggggaaggtcagcacacccaagaactttgggagtgtgtgtctgttttggtttgtgagaaagtagctgcccctcattctggccagttctttccagtagccatggggctggctacaagaagcaaaactgcccatgcaaagagaacacaggtcacttttcaaaacacttgcatcattaccctaaaaataggctgttatgcgttttgacaattgcgctatcctacactctgagggagttggcaacgcatgcggtatagtggagtgggaagagttgagactgaaagttaagagaagggttttcaagtcccggctcatctcaccccagtgactttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtgagtgaattcctggataaagcaagatttcctttcaataaacgctgtcacccaatgggaattttgactct

SEQ ID NO: 3968 - DNA, 915 bp, Homo sapiens
  ENST00000557813
actgtttggcctctagacagccaaagccttttgtcacccaggctggagtgccatggcacgatcatggttcactgcagcctcagcctcctaggctcaagccatcctcccatctcaacctcccgagtagctaggaccacaggcacgcaccaccaaaccagggagtttatagtccagtggaagagaaagactcagaaatcacataatcatagtccaacacagaatccatgcatagggcactgttggagcactgggagagtctacttcaatctgtgggttcaggacggggtcgctaaagtcttgcagaaagaagtcagtcttctgggatatggcttcttcgggaagatactgttaatggggattttggatggccatataatgaaataggaaaacgattaatggaagcccaggaggaaagacttggtgttattatagcagccatcttggattgtgagtgtgtctccaacaccatcttgaaggtgcagtgacttgcatatagtaggtgcttgatatttaccaagtaccccctgtgggtcaggccctactctcaccctaaggatacagcaggaagcaaagcagaggtggagaagatcccactaaacacacaggccgcttggaatgttgggccatctgtccttttgacatgaattttccctgtaatgggggtagagctggtaactgttggatcatctgattattggagacagaagtcctgtcacttgcccctgctgttaggaggtgggcttcctgaatggctttctgtatacatgaagaatttcaagaccttccgttaaggtggtcagagctaagtttcagcgtttacaagaggtctcttggctgacttgctataacttacagcaacctgatgtttggacaccttttcctttttttgtttttagtaaatatgatgagaaaaaa

SEQ ID NO: 3969 - DNA, 577 bp, Homo sapiens
  ENST00000559194
atttcttgttaccgcgcaagtgggataacctccccaccagtgtctagacacagtaggtgctcaataaataggtgtgggtttgcggtggcagaagagcgctatcccttaagtttctgacagtgagggggaaaaaggctaagcagggaaaggaagggaaaggggtaaactgagctcggcgcagtcgagagcgcgaaatagggagggcttcctgcaggccaggaatttggagaggccgaggctgggagaagaaaaatgcccggtgacggcggaggggaggtggaaggacgaacggctccgggaagggctgggagagactcacacgaagcagtttctgacctatcctgtcgtacacaagtcctcggcgtgctcggccggaccatcccctggaaagaaaggggcgtgtgacctttctctccccgatcctccagaccactgcgccgcccagggaggtcatccccgagagagcccccgcctcactcggagcacacattctagctctccccgggacttttccaagttgcatcactgtttggcctctagacagctggaacagtgaaccatggagctgtatttcggt

SEQ ID NO: 3970 - DNA, 1204 bp, Homo sapiens
  ENST00000444189
gagacggaagtttacgacgcccagagcgctccttctggacgtgccctggactcgacttgggactgagtctgtgccgcctaggctggcagggactcggccagatgcactagcggcaaggctgggctgacaccgcctgggactcgctcgccgtacctccaaggggcccaggtcatgagggggcggctggggagacgcccgcccggtgcccgccctgggcccggcgggtgccccctgcccgccgcctgacgcaatccgaggcgcccttgctgcatgccggcgctggagaaacctcccctgccgttgcatcactcctgccaggtttgccacagaggtggagctgaaccaatcagcgggcgcgctgggcccgcggcgcggttaagtgagaagcagaatccgaagttgattggccaaaaggggatttgccccaccccaatcaccgcggcagctggccgcggtgggcgtggtctcccggcaagaaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagac

SEQ ID NO: 3971 - DNA, 1849 bp, Homo sapiens
  ENST00000446533
ggagacgcccgcccggtgcccgccctgggcccggcgggtgccccctgcccgccgcctgacgcaatccgaggcgcccttgctgcatgccggcgctggagaaacctcccctgccgttgcatcactcctgccaggtttgccacagaggtggagctgaaccaatcagcgggcgcgctgggcccgcggcgcggttaagtgagaagcagaatccgaagttgattggccaaaaggggatttgccccaccccaatcaccgcggcagctggccgcggtgggcgtggtctcccggcaagaaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctctttatctgtgc

SEQ ID NO: 3972 - DNA, 1498 bp, Homo sapiens
  ENST00000617961
caggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctcttta

SEQ ID NO: 3973 - DNA, 853 bp, Homo sapiens
  ENST00000487220
aaaatatttcttccctccctagcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatcc

SEQ ID NO: 3974 - DNA, 1560 bp, Homo sapiens
  ENST00000617768
aaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctctttatctgtgc

SEQ ID NO: 3975 - DNA, 11568 bp, Homo sapiens
  ENST00000423902
cggcggcggcggcagcggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggccagttttgttgcatctggaaataggacagatatttccttggatgatccaaatttctggcaaaagtgggctaagaaggctgaattggatattgatgccttaaatgggaggaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatggttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaaggtcctgctgcgtgtccgcatgctgtactacctaagacaagaagtgataggagaccaggcggataagatcttagagggtgctgactcaagtgaagccgatgtgtggatccctgaacctttccatgctgaagttcctgcagattggtgggataaggaagcagacaaatccctcttaattggagtgttcaaacatggctatgagaagtacaactccatgcgagctgaccccgcgctgtgctttctggaacgagtcggtatgcctgatgccaaggccatagctgccgagcaaagaggaacagacatgctagcagatggtggtgacgggggagaatttgatagagaagatgaagacccagaatataaaccaaccagaacaccgttcaaagatgaaatagatgaatttgcaaattctccttcagaggataaggaagaatccatggaaatacatgccacaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatgaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccaaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgcagagatgtaattatagaatgtagtatatagggaaactggtgttcactctattttttttgtattcgcaatagatgcaaatacagcattctggcttttgtacagtttcttgatatatcctcttatactagattagcttttggtaagacactaaactgtctcgaagactagacaggaaggaaaaccttgaattactctcacataattccactccagatatctcaacagaaatgcatacaaaaagctcctattactccctcaaaagggcatctgagaccgagaatacttagaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgtcagcaagggacacaaaggcactctggtgtcctgcagaccagcgctcgatgccagaaaccagtgtgtggaaaaacccatgtggaattgaaacagacccacttaagcacgcacgcgcgcacgcacggtctcaggagctactgatttgtggacccctttttgacctttggtatttaaagtaaaatataatttgagatctactgttttcacctttttatgtcacctgaaccaacacaaagccatatttccatccagttaaaaagcaggggaagggatgtggacgagagtgtttcgtgtgtgttgccttcctccacacccttcccccaggacgtccgcacacagtccacctccagccagtgtgctgccagacaggtggtctaaattcctcccagactgtgagattcagttcgtttatgccccaagatgaaaatatgccccttaatgattctgggaaagaaacaacctgaaccctccaccttacagatcctgtgattgcttttatttatcatcgtcgttgtctgctgaaagtgaatgggccgtgcacactggaggaaagtgccttgaagagaatattttttgaaagggaattatttgaacacgggaaagtgaaactaggtctgcatgaagtataggaaatttaagtatttaagtaacaaagatgttagcagggagaatttgcttaataaaatgagtcattaaagggtgttttttttaaa

SEQ ID NO: 3976 - DNA, 500 bp, Homo sapiens
  ENST00000526846
ttgggctccaactcaagtgcgagcgggcgatgggcgcgcgggcgcggggcggctgagcagcggcggcggcggctcggggacggcggcgacccccgcctcccgcccccgccccccgctccggaccgaccacgccgcgctcgccgggagctgcggccgcaccggcgcgaacaaagtgcgttcctcccggcgcggcggcgccagcccgcgcggggaccgccaccgagcgaggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatcc

SEQ ID NO: 3977 - DNA, 3456 bp, Homo sapiens
  ENST00000524602
acctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaa

SEQ ID NO: 3978 - DNA, 4777 bp, Homo sapiens
  ENST00000525508
atggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggtcagtgaccatattggtgattgcactgaacctgaatagaattgttgctgacttgatagtcccgttgctcagaatttgatgcctgtaaacagtatttgaaaagcttgtcaaatattgtgatatattctctggcactttcagttattcaaaagttgttgccttttggattcttacattgttggctagtgtctgttaaacagttgtattatagcagagtgtaatcatgatagtttcactaaagtgagtttcaagtatttgttttaccctttgttcataaatacaggttgatcataccaaatacaaaaatcccagaatccaaaacgttttgagtacccacataatgctaaaaggaaatgctcattggagcattttggattttggattttctcatttgggatgttcaacccgtaagtataaatgcagatattccaaaatctaaaaatatctgaaatctgaaacactctggtcccaagaattttggataagggatacttaacctgtactgccatttcattaactgttgggccaagctttacttcagtgatgatagtccagttatttttcagtgctcataggttttgccatactgtggccagcaggacttgtagatgcaagttctcaatgagttgggtaggatatctggggttggtttagttcgcacagatgcttagaagtttggggcattacagtgcctcagatttgatctggagttttacaccacacttatcccatagtcttccagcttcccaagagatgatcaggtcttcctgattagattttctagatttttttttcagcaggagcatcatggaataacatatcgtaggagtagaaggatttgatttattttctgtctgatactgctgtgtgtgatttcctagtgggaattgcaacatgacctgtcatcctcaggcttcttttcactccatagtttatatagtggttatgatcacttatattttatttttaatgtacatttggaaagcaaagctcctgtcatttagcatgccttggatgatttgatgagtttcacggaagtacaaaaagggtttcaaagtatttttaatgctaatttctgcaggctaatttgatcttttgttaactgagagtttgagatgagaaggagtgttctgtatattcatggccatatgtttttagctgaagactggtattaccaaaaaacacctaaaagctttttgttgcagctgattctctgaaagagcagcttattttattcttaaagagattagaattgccagctatgcttttagtttaaaacaaacaaaatctagttttgcttaaaggaaaaagtctgactgaattatcctatttagggtgggatttcccatttttcttcctaatgaattattattaaagcgatcctaagatctgtctcaaa

SEQ ID NO: 3979 - DNA, 434 bp, Homo sapiens
  ENST00000527825
cagctccatgtggggccccagggctgttcaggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaa

SEQ ID NO: 3980 - DNA, 398 bp, Homo sapiens
  ENST00000527900
caccagccttgggcacagctccacccatcaccccagaacaccccgcagaaagtgcctgtgcatcagcattccccgtcggagccctttctagagaaaccagtgccggatatgactcagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcagg

SEQ ID NO: 3981 - DNA, 527 bp, Homo sapiens
  ENST00000527921
agatgtttaccagtctactctatttgggagaatttgatagagaagatgaagacccagaatataaaccaaccagaacaccgttcaaagatgaaatagatgaatttgcaaattctccttcagaggataaggaagaatccatggaaatacatgccacaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtggacaagaagagaagaggctgatttttaccgtgtggtatccacctttggggttatttttgaccctgtgaaacagcaatttgactggaaccaatttagagcctttgccaggcttgacaaaaaatctgatgagagtttggag

SEQ ID NO: 3982 - DNA, 788 bp, Homo sapiens
  ENST00000529472
aataatcatcctaatcaccataacagggctgtctggtttaaaacaacacaaaaaatgagcttcagtcagcctaccccccaggctcgtctttcccagtattattgtgtaagaaacaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgc

SEQ ID NO: 3983 - DNA, 507 bp, Homo sapiens
  ENST00000531695
tcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccagtgagtattgcagagtttagagttggaaggaatcttgcaggccggtccacttcattcccttacaacatagaaatccctgacagctggtccctctgccttttccttgaatgtttcctggtctcaaacatttcccaggtctttgttgttgaatcttcttcattacagatactagcttcaggtctgtcttactgaaggcagccttacagttatttgaagatgcgcgttatgcatttccttactgtttgcttctccc

SEQ ID NO: 3984 - DNA, 4222 bp, Homo sapiens
  ENST00000618450
gaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccagtgagtattgcagagtttagagttggaaggaatcttgcaggccggtccacttcattcccttacaacatagaaatccctgacagctggtccctctgccttttccttgaatgtttcctggtctcaaacatttcccaggtctttgttgttgaatcttcttcattacagatactagcttcaggtctgtcttactgaaggcagccttacagttatttgaagatgcgcgttatgcatttccttactgtttgcttctcccatcaaactcatgtgacttcttcagttattctttccatggcatcgtttccaggcagtcttagtattggggtaacactgttgaatgcactttctccagtctccagacgaggccccgccatcccagagtgctatgaagccaattacttccagagatttgaccagttagtgcagcccaagattgtattagctgcttttatggcaactaatcctggtgccttatattaaacgttagacagttcatatctccaaatggtttgtcacacgaactgtttgctagctagcaatgcaagtcttttgctttctgtatttatgtgattgattttttaaaacttaaatgtagagttttacattttattttgttgggttcagcctagagttcttgccactcagaaagtacccccaccccctacaagatctgtctgtttgttggttagttctcattacagacagtctcatgttgttgatggggtatcatctctgtgttcattggagccactaactagaaattagtaaaagtactacagaaagcctcctttaaaagtatcatgacttggttaaacatttaaagaaaaactttaagtgaggttattgatagataaaaggaaaagccaattctcacttatgtattccttaatggacgggtaaaataggagttttttctttcaaagagaaaaatatggtttctaatattaataattaaaatgattcttgaaacttccataataattgaagatgatctgacagttctctttggcatttatatagagaagaataagtactaaataccaattttactaaatatgttttttcttttgcagaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaaggtaaacgctgggaaagggaattgatcactatgcgatttcttagcccagaaggaagtgttttatcctgccttcttctataggggaaaagaatcctgtctgcccgaatgcgtgtgtgcgtgtatgtgtgtattatagaagggggagggagtagattaacagaaaggggagggaagactgtgtttttaatcatttgtcaaatgcctctacccagatgggtggagctatggcgcctccaatgaaggatctacccaggtggctggaagaaaatcctgaatttgcagttgctccagactggactgatatagttaagcagtctgtaagtacaaactgcatttctatcaagaaaggtagctatacaaaactgttttccttagtctttcttattttctgttggccattaattattcagttgtaacttagcttaaaagaattgacataatacatcattttcatacatcatttcatacatcattaatacatcattaatccaaagtgaattcatttatcagctccaatttaaaaggtttgtatggaaacatacattcacaatcttagaggtagacttctccaggggggattgccccagctaagcctacttaacagctcacctgtggaataggatgtatggtggttgagatcattaagattaactgtgatttctgatttaaaaacaaaacaaaacaaaacaaaacaaaaatacaacagttctgcctaaaagatttgttaccattagctttttaaaaattcgttcatgacatgctggttctttgttttaattatacattaaaaatgtctttcggtgtaacattctgttgatcttaacacacgtgtgagtttgtgaactgacaccgtagtcagaatagggttccatcccccacccccaccaccccgagttccctcacaccgtcctttccccgaccccagcccctggctgccgctgacctgttgtccatccctgtctttttgagaatgtcctgaaatggaagcatgaaggacataagtcttgaagcagtttctttcgctcatcatatggaaggtcatcgatggtcacatgtgtcacagttatctcctttctgttgccaagtagctgtctccattgcatagatgtgacactggacggcttagccctcacacactgaaggacatctgggttatttcctgatttttgaaactatgattagagctgctataagcaattgtgtacaggttttggtgtgaacataagttttcatttttctagggtagatactaaaatataattacattttccatatttcaaaaatacttttacatatatttgaaatatccaaaataacacattatagagggcataaaacatcctgggtttatattatgttatactattttataatttttctcccatacaatatctttttttttcttttttttttttttttttgagacaaggtgtttgtcacccaggctggagtgcagtggtgaaatcacagctcactacagcctcattctcctaggctcaagcaatcctcccacctcagcctcccaagcagctggcactacaggcacacatcaccaagcttggctagtttttgtattttttgtagagaaggcattttgccacgttgcccaggctggtctcaaactcacctcaagcaatctgcctgccctgacctcccaaagtgctgagattacaggtgtgagccactgtgcccagccaaaatttttttttaattgacagatatttaattgacaaaaattaattgatgaatcaaatatatatgcaaggtgtacagcacagtgtttttttcttttaagagacagggtcttgctgtgtcacccaggctggagtgcaatggtgcaatcatagctcactgcagcctcaaactcctgggctcaagcagtcctcccacctcagcctcctgattagccaagtagctgggatgacaagcatatgccaccacacctggatattttttttttattttgtagagatagggtcttgctatgtgccccaggctggtctcagactcctgggctcaagaaatcctctagtcttggcctcccaaagtgttgggattacaagcatgaaccacggcacctggcttcaaagtgatgatttgatataattatacattatgtactttcctttttaaaaatttgttatgggtacatagtaggtgtatatatagggtacatgagatattttgtacaagcacacagtgcataatgatcatgttgggtagatgaggtatgcatcacctcaagcatttaccctttgtattacaaacaatgtgattatactcttttagttattttaaaatatacagtaaattattgttgactgtgtagtcaccctgttgtgttatcaaaaactagatcttactcatcctgtctaactctatttttgtaccccataatgtactttctgatgtatgatttcttgagttagttatggatgcagctaacttgacatttacctcactgatgagtagccttgagcaatttttctgcagttcagcaagctaacataataataaaaacaagttttgctgtcattaagttttatcattgagctgttaggagggaagaactacttaggtatttccatttggaatggcaggttcaccacagaggctcacattgagatcaagttgtcttcgacagcctttatagccactgtttgcctcccctgtactccagggttttgttcctgagtcgatgtttgaccgccttctcactgggcctgtagtgcggggagagggagcgagcagaagaggaagaaggcccaaaagtgagatcgccagagcagc

SEQ ID NO: 3985 - DNA, 616 bp, Homo sapiens
  ENST00000532149
agaaaaactttaagtgaggttattgatagataaaaggaaaagccaattctcacttatgtattccttaatggacgggtaaaataggagttttttctttcaaagagaaaaatatggtttctaatattaataattaaaatgattcttgaaacttccataataattgaagatgatctgacagttctctttggcatttatatagagaagaataagtactaaataccaattttactaaatatgttttttcttttgcagaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccg

SEQ ID NO: 3986 - DNA, 566 bp, Homo sapiens
  ENST00000528280
caaatgcctctacccagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcact

SEQ ID NO: 3987 - DNA, 7665 bp, Homo sapiens
  ENST00000315251
cgtgtccgagcgctggcggagcacgggccgccgcggcgcgcgcctacccccgcgcacacgtgcatgcagtgagccaggtgcatcagctgcacccgccctcgggcttcgcgcgcctccgctggagcccagctagcctcgcggctccggggccgaccgggtcggaactgctgcgtccccattccggacgcagagagcgcgcggggcgccggcgccgccggttaaagtgccgcggggcaggggccgggccgcggccacccgctcctcccgctccggtcccgactgtcgggctctcggccgagtcgccccggacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgctcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggcccatgcggggcacgagtgtgggctggctcaaactgagaagtgccaatccccaagaccaccctgtgatccagcccaactacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggtgacagggtgagaccctgtctcaaaaaaaaaaaaaaaaaaaaaaacctgagatttttttggaccttattcaaggggagaggagtctggagggaatgccgcttggcttcactaccaaaggttttatgacttagcattttaaaaggttttccttttaccaagaaatgcagaaaccaagagcaaaccccacgtaccagatcactgattcctactgaagcagctagcccgagaaaggactctctcatactggtcttgggaaatgacttggcagcctgagccatcccagcagtggacaaggatggttaattcttattctgtagacgtccacaggaacagactaggatggaaaacacagttaagcacagccatgcaccctgtggctgtagaaatgcccctgtgtgaaagaaaaataaattcaagactggagttttggaggaaaaaaaatacaagtagcatttacaacagctctttgctctttaaatttcttaccattcaataaagtgatccagtcactcacatttgaactgagatgccttctccagactgttctgacaaggtaatgaaaataaaatgcacttggatttttccagacatccacatccaccgtcaagggctgggaagaaaagcattgttgcgtggaaacctgcagctatactaggcccagaataaggacgggaggaaattgggggattccaggctttgctcggatctgagaggattggggcggcttacagactggggcggggggggggggcgtccgacagccacaagttagttttctgagaaaaaccttcgagagaggcagcaggaagaaacccatcacacctctccttttaaaaatcttaagcagctcttgtttaatcttacctgtattttttaaaatttttgttcgaagagagggtcaagaaagaaaattctaaaccggccaagagacttatttctcctacggagggtccccacctgccccacagcagcagtccatggccatcagtcacctgggtctcggggctgcctgcaagagtgcagaaacaggagttcaggtgccagccccgtaacttggagggcctcgtgcagctttcctgctggagcgtgtgtggattcaggggcaggggatagtcctggaccaaccatgactgtgctgacccttcttctctggaacaggtatggatatggcagggtgacagtcacttagttctaccatctctgtgtcccatgggtgtgtcagtgtctgagaccatggtgggttcagtctggtggctgtattttaaaataagcaaaacgtcatatggtaagaggagcccattggtgatgctgctcaattgcacccaggcccttctttcactctcaaatacttagccatgttctacacaatcgcacaatttggccataaacaggaatgaggtttaaaagaaaagatggtaagtgtcacatgtccagaacctgagcgttcccctgccatgaagggagtctttcattcaccccaggaggagaggctgtcacctgaggaagccagcatgggggagaaaggcacttgctacaaagtggggtgcacagagggtacccccccatcttcagtctcatagggaattgggccccttggccaaaagcttgcagtacctaaaaacagagaaacgtgctttgcaaaaatggctcaaagagcacaacagaatgcgctgtccatgtgcccagtgctctcaggagccctgacctattgcagaagcctgtgttgaagccgctgcactagtagaaggcagctcctgatggaataggggataggggtgggctgtgtgggagccaagagcatctggcagcctgactggagatggtgagttcctgaagcaggagttgtaggcacccaaacatctagtctttctgcttgtagcgaaggttgcaggcatcatctccacgaattcaaatagattcttcttggctaggcatggtggctcacgcctgtaatcccagcactttgcaaggctgaggtgggtggatcacttgaggccaggagtttgagaccagcctggccaacatggtgaaaccccgtctctactaaaaatacaaaaattagctgggcatggtggtgcacgcctgtagtcccagctacttgggaggccgatacaggagaatcgcttgaacctgggtggcgcaggctgcagtgagccaagattgcaccactgcactccaccctgggtgacagagtgagactgtctcaaaaaaaaacaacaaaaaaacagattcttctccacccaaccatgtcccgccactcagaagtggtttcatgcttctactgataagccaacttaacatcagatccaatacagattttttaaagataaaataccatctctactggacctgtttagtggctcaggctgccctcacaggacatccctgagaccaccctgtcactcttgatgttggaaccagggcccaggcctgctcctcattgtctcctgccctcctagtccccaggagaggaaaagaaatactgttttagagaaataacattttcaacaaaacatccctggagtcagattttgagttggggtgggctaatcagggagtcggggctctctgcgtgatgtcagttctatggctaactggtttttctaaaccagccagctgcctatcaaaacagtacaacttttctaggaaatgcaattggcaaagacacttacgatgctgagaagtacacaaggtgaaactgctccagtttttctcatagcagggtcagcaggaaagcaagtggtgcccctggtcccatctcacacaggtgagactgcaccgagaggtaacgtggccctcacagcccaccacgcctggccttcgcccaattctgaaacttcgtaggatagagctggaaagtgccacatggtgaagcgagatccagctgtctgggtggatgtcggagtccataggctgagcagagatggttcttagtgaggttctcgctgccagttgacggtgaaatcatagctgccatttacattttgtgagattatgaaaaacataagactaaagaaactaaatgtgttattcctgtggacacaaaaatgtgtgtttttcagatggggaggggaccaaaaaggaaaaacatttcatcttaaaactttcctaagacaagggaaaacaaaaaaccatgctctacaacttcaaatttttcttacaaagaaaaatttaatattcgatgagaggttgaaccaggcttaaagcagacatactaggaaatggtgcagcctgtaagaatgccagtttgtaagtactgactttggaaaagatcatcgcctctatcagacacttagggtcctggtctggcaattttggcctgatgtgatgccacaagacccaacagagagagacacagagtccaggataatgttgacagtggtgtagccctttaggagaaatggcgctccctgcggctggtattaggttaccattggcaccgaaggaaccaggaggataagaatatccataatttcagagctgccctggcacagtacctgccctgtcggaggctctcactggcaaatgacagctctgtgcaaggagcactcccaagtataaaaattattacacagttttattctgaagaacattttgcattttaataaaaaaggatttatgtcaggaaagagtcatttacaaaccttgaagtgtttttgcctggatcagagtaagaatgtcttaagaagaggtttgtaaggtcttcataacaaagtggtgtttgttatttacaaaaaaaaaaaaaaaaaaaaaaattaacaggttgtctgtatactattaaaaattttggaccaaaattgctacctatcatctatctttttgattgcagggaatccctgccaaggtaacctgacagtcggcctaattctgttgacagaaaatgaagccttgacggttctaattatccaaaagtgggttttcatcaggacgtacagtcagagtgtgagtgcattctaatgaaaacttcagccctcattcaattgcatataaaagccctcaaagagaacatacagtacagcagttttgtaaaaggcaacaatacgatttgtacagaccccgacactccaatcctatagatcaccacgttgctcctctgtccccagcaccccttatttcttaagcagcaccaccagtccccagaggacaagagcagctatatctcatccacctatgcatttctgcaccagcgatgcaaaaaacaccctgggtgggccacagagaaaaccgtaactatggatacccaaggggcagagcagccagctggacctgctctgtaattcacttacttacttaccagagggtggttcaagtcaaacaaacaaaaccaaagacagttgcaacccatggtggatccaaaggtacagtatcaaaatcatggaactcttgcccaaagaaaagactgcaaatagtcatctggtatatcttgtggaaagatgataggtttatagtgactcaaaatattttagaaaaatttctgtagtgtcaagttctttcaaacttaaaattttaaccccagaggattttcgctgaataaatgagaattggctcta

SEQ ID NO: 3988 - DNA, 631 bp, Homo sapiens
  ENST00000481668
tcggcacacaggctttgagacaaccagggtgcggagacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgctcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcc

SEQ ID NO: 3989 - DNA, 565 bp, Homo sapiens
  ENST00000467802
ggctagtccctctgagacgagcgagcaggcagccattcactaacatgcgttcattccacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgctcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgc

SEQ ID NO: 3990 - DNA, 2550 bp, Homo sapiens
  ENST00000378961
ccgctcctggctgcccgctcctcccggccctgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 3991 - DNA, 1129 bp, Homo sapiens
  ENST00000455042
cacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggtcatttatttgcagaagatattacagatttccagcggaaagagaaagtgctgaaatgggtgtgttctcaagtagccatttggaggatgaaagaacactgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggagga

SEQ ID NO: 3992 - DNA, 2030 bp, Homo sapiens
  ENST00000488832
acggatgcataaacgagcttgttcaggcaaaggccttgcgggtgaaaaatgaggtaattaattatggaagacatccataaccatgtttttgtcaaggaagtaagttttgggaggatatatttttggaaacagagatacggagagagagccacagatctttacctatttggggtaggcagagaaggaccaaggagggcattcttgttttattagacttagtttggtttaaacttttttttttttgagacggagtctggccctgtcacccaggctggagtacagtggcacgatcatggctcactgcaacctccgcctcctgggttcaagcaattctcctgcctcagcctcccaggtagctggcgcgtgccaccacgcctggctaattttttgtagttttagtagagacagggttttgtcatgttagccaggttggtctcgatctcctgaccttgtgatccaccagccttggcctcccaaagtgctgggattacaagcatgagccaccgcacccagccctagcttaaacttttaattgaaataaaatatatagaaaatggaacagatcatgagtatacagcttaatacgcacacctgtgtaaccagcactgagattaaaaaatgggacatttctggttccccagaagtcccctccttgtctgtggtctagatttgatttataccggatctaaaatagcatttgtttccaaatatatttaagacattgccaggggaaaaacaacaactaatgtggggtgattttgtcagttggggtcacacagctttcaaaaaccaactcaagtcattttccattctttttctccttcaaagctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtaagtgtcccacacggcaggcagatcttggtcactgcagtgatccttgttcctactccctccacatcaccttctactttatctacaaatgacctgggggcataatgcactaggaagagtattgattgactaggccagtatctgggagacagaagatatgactcctagttcctgctttaccacttcgcagctgtgtgactataggaaagacagtttgcctctcttttcctcaaagtaaaatgaaggagttgaactcagtgatagtctttcagatgtctatccgttcttaaattccttagttccatactttggatttttagaaccggacttcctttgggtggagggggtttgggaaatgctggtttgtgattagatgaggaggggggttatggaagtgttggacaatgacagagggagatttaaaaatcattcttctctttgccttttgctcttctgacagtgagaatcaggaagctgagaagcaagaaacttagaaaggtgacttaaaattctggcctatttacacaacaaattagctaagatattttaatgtatagcttactagaatagaaggtgccaccaaatggtaccaggagttccaggcctgagaactggaagggtttcaggtagaggcagtgcattccagtgaggcagactaatggctttctgagtccagcctgtgaagtgttctcaatatgaaaccatttctgctgaaaataaaatttgaacagtaatataagcagtacccattggaaattgacattatgaggtcaattttacaaaactatgcagtctctgttatgcatgaagccacactgattcaaacaaatccagaaaacactgccctcttcaacactgtcctctgcttttaaacttttagtcaggctgggaacagtagattttatcttattttttcacctttaaaaatctttcaggtgggcatagtggctcacacctgtaatcccagcactttgggaggccgaggcaggtggatcacctgaggtcagcagtttgagaccagcctggccaacatggtgaaaccctgtctctactaaaaatac

SEQ ID NO: 3993 - DNA, 619 bp, Homo sapiens
  ENST00000532909
ctgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctagagagccacccagacgtccccaccgagtccagcacggcaagggtgcaggggctgccctagaaatgggctcagaggagcctggcccaccctcttgaaactggtcctggaccttggctcagctctgccgcctcaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaaga

SEQ ID NO: 3994 - DNA, 602 bp, Homo sapiens
  ENST00000529539
cccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaaga

SEQ ID NO: 3995 - DNA, 3374 bp, Homo sapiens
  ENST00000323578
gaatgcgcggtgactcaaaagtgctggccacgcgctcgttcatccaagcgcgaggggctgagttgggaacttggtttgcctcctggggctccggctcgtgcaatgtgcaaggcgggggtgcggaccgagagagcgcgcgtttcgggcagtccccgctggagacagcgcagtgggcgccatcggcctggggatggagatggtccactcaggcgggggtcggggggacgccaggagtggtgactccgggtccccgggggagcgtgccggggcggagcccaccgcgcggttctcccggcaccgccgagccgggcagaggccctggagcccaaggccccgcgcggccccacgccaagggcgccaggcctgcctaagagccgtggcgctgggaacccggctacccctgggccgggaacctgataaccagctccagcgcgagcaccaggggcgctcaaggtgaacgcgccgggcccggggtccgcccccggcgcggccccgccccggccccggccccggccccggccccgactttcgggcagccctgcccagtcccctgtcctggcccagcccctctccatcccagcgtgccgtgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaag

SEQ ID NO: 3996 - DNA, 1171 bp, Homo sapiens
  ENST00000534207
aggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagc

SEQ ID NO: 3997 - DNA, 1289 bp, Homo sapiens
  ENST00000429789
cggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 3998 - DNA, 1431 bp, Homo sapiens
  ENST00000528581
gtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggtgaagttttgctcttgttgcccaggctggagcgcaatggcgcgatcttggctcaccgcaacctctgccacccagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtg

SEQ ID NO: 3999 - DNA, 1477 bp, Homo sapiens
  ENST00000436108
gcgctggagcgttttccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgc

SEQ ID NO: 4000 - DNA, 553 bp, Homo sapiens
  ENST00000524538
ctgaaaggacttggtggggtggcttcttccgaggaagctcctggaagatgtttttcctgaggtttcctctaatacagggttcacacggcctggggctctggccaccccaccaggtgttgtcccccagaccactggggacagtggctgccccgagtggccctgcccctgctgagagccacagcctttgggggtacagggtggggctgtgggggagctgggtgggctcccaaatccatatcctggtctccccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcct

SEQ ID NO: 4001 - DNA, 323 bp, Homo sapiens
  ENST00000528521
ccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtacatccagacactgaaggaccacaggccccggatggtgtgggacagccaggcctcagagcacttcttcgagtacaagaagagccgcagtgggaggcacgtcgtcttctacccaaccctgaa

SEQ ID NO: 4002 - DNA, 976 bp, Homo sapiens
  ENST00000526714
tgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccagacactgaaggaccacaggccccggatggtgtgggacagccaggcctcagagcacttcttcgagtacaagaa

SEQ ID NO: 4003 - DNA, 321 bp, Homo sapiens
  ENST00000528534
ctgggttcgagcctgcgtccaggtcctggacccgaagtccaagtggcgaagcaaaatcctcctggggctcaacttctatggtatggactacgcgacctccaaggatgcccgtgagcctgttgtcggggccaggaagctgtgcaccaccaggctgtgtcttctgtctgctgcctccaggacacggaatcgttttctaatggtggctcagggcggctcacagcataccatgactgctctacctttggagccaggacagccctagcagccggtgggtcaagtccaaggggtgctgcatgtggtgactcacgcctgtaatcatta

SEQ ID NO: 4004 - DNA, 878 bp, Homo sapiens
  ENST00000524832
ccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccagtgttcatggagcctcttgagtctgcattcgtactcttagcaaacttggaaaatttgaggccaaattcttcaaatattttttctgtttcttctcttctgtcttctcgtttggagaccacaaacactagatccattgaatttgtcccacagctcacgaatacaccttttaccttttggaattcttttttt

SEQ ID NO: 4005 - DNA, 408 bp, Homo sapiens
  ENST00000531010
gttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtgagccaagggctctccctgccgtgctgaaggtgtcactgggcgcgggtgggtgtgggtgtaaggagacagagtgatggggagggtctcggtcccctggggcttctgccccacagagtcagagataggggctgggccaggagccggtcctgcttggtgcccacccca

SEQ ID NO: 4006 - DNA, 834 bp, Homo sapiens
  ENST00000531859
cctccctgacccagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggt

SEQ ID NO: 4007 - DNA, 1019 bp, Homo sapiens
  ENST00000534254
tccttcctccctgacccagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaaggttctcatccttcctgcttgactgtgcttgccccacaggctgaaaagagtggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatca

SEQ ID NO: 4008 - DNA, 991 bp, Homo sapiens
  ENST00000528426
gcctccctgacatgcaggtgagccccgcggcggccggcccctgctcctcctccttgcacggcctcagtttccctcccgcaaagtgggcgcgccgggcagcgaggctcggccccgggaggacgggcgtggggtcgcgggcgacgccgggcggatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggctggagcgcaatggcgcgatcttggctcaccgcaacctctgccacccaggttcaagcgattctcctgcttcagcctcccgagtagctgggactacagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaa

SEQ ID NO: 4009 - DNA, 752 bp, Homo sapiens
  ENST00000533056
ctggtgtgtgtccctctcttcctgggcttccggcctctgaactagaatgtttcaaggcctaggagtgacaggacgtggtcagcaatagtggcccaggtcctgcccttgggtgacccaggccaaggtctcctagttagaacaggacagagtcacgaggctgccactgttgggaagggccctgcctgtgctgactctgcaaatgaggagtcgcccagagccgccgcgaccccacccaggagcactggccagcctggggaagacacaaacccagccccaaaggccccacagccaccaggcacctccaacaaccaggtccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagg

SEQ ID NO: 4010 - DNA, 578 bp, Homo sapiens
  ENST00000533059
gcactggccagcctggggaagacacaaacccagccccaaaggccccacagccaccaggcacctccaacaaccagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgag

SEQ ID NO: 4011 - DNA, 571 bp, Homo sapiens
  ENST00000530939
gttttccggccgtgcgtttgtggccgtccggcctccctgacatgcaggtgagccccgcggcggccggcccctgctcctcctccttgcacggcctcagtttccctcccgcaaagtgggcgcgccgggcagcgaggctcggccccgggaggacgggcgtggggtcgcgggcgacgccgggcggccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacg

SEQ ID NO: 4012 - DNA, 523 bp, Homo sapiens
  ENST00000525225
ccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagcctctcggaactgccgtggctgttcaagcactcactgcctttgcctgtggctccatgtactgggtgctgctgtgcttgccctccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctat

SEQ ID NO: 4013 - DNA, 438 bp, Homo sapiens
  ENST00000525840
agacacaaacccagccccaaaggccccacagccaccaggcacctccaacaaccaggtgtgagtaatttttttttttttttgagacagggtcctatctgtcgcccaggctggagtgcagcagtgcaatcacagctcactgcagccttgatgtcctgggctcaagtgatcagcctcccgaagtgctgggattacggcgtgagccaccactcccagccttcgagtgcttttgaggatgtctgtgagaggcatcctcaggctggggacccaggaatatcccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggtaag

SEQ ID NO: 4014 - DNA, 594 bp, Homo sapiens
  ENST00000528154
acagccaccaggcacctccaacaaccaggtgtgagtaatttttttttttttttgagacagggtcctatctgtcgcccaggctggagtgcagcagtgcaatcacagctcactgcagccttgatgtcctgggctcaagtgatcagcctcccgaagtgctgggattacggcgtgagccaccactcccagccttcgagtgcttttgaggatgtctgtgagaggcatcctcaggctggggacccaggaatatcccaggtaaggcatggggtctcctaaagcagggatccagtcagcagcagaaacactcatctctgcaggcctcctcaccccaccggcctgcccctgccctactctgtcccccccatgcccacggcagacaggcagtgggcaagcaggagggcctcagggcaggtcagacctgggcctacagggcagagcctggacctccgccagggcactccacacccaccccggccctctggaccccgaggttggaccctactgtgacacacctaccatgcggacactcttcaacctcctctggcttgccctggcctgcagccctgttcacactaccctgtcaaagtcagatgccaa

SEQ ID NO: 4015 - DNA, 3255 bp, Homo sapiens
  ENST00000454838
atgcggacactcttcaacctcctctggcttgccctggcctgcagccctgttcacactaccctgtcaaagtcagatgccaaaaaagccgcctcaaagacgctgctggagaaggtgaagttttgctcttgttgcccaggctggagcgcaatggcgcgatcttggctcaccgcaacctctgccacccagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaagacatggtggcatgtgcctgtactcctggctactcaggaggctgagatgggaggatcgcttgatgaggttgaggctgcagtgagctgtgaccgactgcactccaaaaaccttgtctaaaaaaacacaagctgccactggctttggggcactgaccttgtctccccagaggtgctgacgctaacattcaagttgttctcgggggtcctgtggcttctgttggagtgagggtgggggacacgcaggtctgggagggtggtgtgggcctggagctaggcattgccagatcagcattgggtggaggcaggggtggggatgccacacaggatgggatgtctagagcgggctgtgtctcccggggggatgggcagagggtggggcaggaattagctggaaatgagattgtggggtgcagtttggggatcagatgccccaacctgaactgaccgtcatccctgtggccagggtccccacacaaccctcacccctggctgtgagaatcctgaggcaccttgatgcattttttttcatgccctgtg

SEQ ID NO: 4016 - DNA, 3537 bp, Homo sapiens
  ENST00000449825
ctggtgtgtgtccctctcttcctgggcttccggcctctgaactagaatgtttcaaggcctaggagtgacaggacgtggtcagcaatagtggcccaggtcctgcccttgggtgacccaggccaaggtctcctagttagaacaggacagagtcacgaggctgccactgttgggaagggccctgcctgtgctgactctgcaaatgaggagtcgcccagagccgccgcgaccccacccaggagcactggccagcctggggaagacacaaacccagccccaaaggccccacagccaccaggcacctccaacaaccaggtccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattagcaagacatggtggcatgtgcctgtactcctggctactcaggaggctgagatgggaggatcgcttgatgaggttgaggctgcagtgagctgtgaccgactgcactccaaaaaccttgtctaaaaaaacacaagctgccactggctttggggcactgaccttgtctccccagaggtgctgacgctaacattcaagttgttctcgggggtcctgtggcttctgttggagtgagggtgggggacacgcaggtctgggagggtggtgtgggcctggagctaggcattgccagatcagcattgggtggaggcaggggtggggatgccacacaggatgggatgtctagagcgggctgtgtctcccggggggatgggcagagggtggggcaggaattagctggaaatgagattgtggggtgcagtttggggatcagatgccccaacctgaactgaccgtcatccctgtggccagggtccccacacaaccctcacccctggctgtgagaatcctgaggcaccttgatgcattttttttcatgccctgtg

SEQ ID NO: 4017 - DNA, 8023 bp, Homo sapiens
  ENST00000256509
agggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaaa

SEQ ID NO: 4018 - DNA, 662 bp, Homo sapiens
  ENST00000481167
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatcca

SEQ ID NO: 4019 - DNA, 5235 bp, Homo sapiens
  ENST00000397491
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattg

SEQ ID NO: 4020 - DNA, 572 bp, Homo sapiens
  ENST00000427688
agaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaac

SEQ ID NO: 4021 - DNA, 543 bp, Homo sapiens
  ENST00000421198
tcggacagctcggggtcagtcgacggagcacaccgggcgcccgaatccgccgggtcccactcacgcccgccggccgccggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacga

SEQ ID NO: 4022 - DNA, 2564 bp, Homo sapiens
  ENST00000489224
gaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtgctgtaaactgcaaaccataatcctgtcttaatactgcaaacaaatcatagtggaactaaggggaacttaatttactgaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatccatgcatcttaacagaaggcttaagtagttgaatgacagggactacatttttgctgcagaagatcatgataaaacatgtgctgtgtggtcaccttgggtaatgtgccgagactgcttgatggtacttatctctacacactgcatctcatactgatttatggatttggatgacttattttatgtcaaagacataaagagagtagagaagagagaatagtattttcatttcagtcttaaaaaagttctatcctatgagatgttaacagctgccttctcttggtggtctgtgaagtttttataaagatattgattattttccaatgacacacaaatctactgctagagaccattcaaatgcttagttacaccagggcttggctcctgtaccctgaggaggacacgattaaccaaatcctcctttttaaatgttctcaggacaatgagctgcacatacggcacaaatgcaatttgcttgaccaatcttgcctctgtctccttctatctccgtttacatgcttcatgctcagttgaaattaattctctacacattggtctcatgaacacatctttgagagcagagttcaagttaaatttttattttcatcattacctctgagaacacaatctggggcatattagacgctttgtaagtgtagaggtggggagaaagaagaagaaagagaggaacagaaggagggaaagattttcctgatagatcactttctggacactttctgtgctgagaagttctgagattgcctctctggatcctgctatcttggcagtcttgctaagagtttccatttacacttaaacatggttactgatgcgtcttaatgttgccttaactatcaggtttctgatagccccacatagccaagtgggaccctggtcaagaagttcacctctgttaaataaatatgcatagattttcaacatctcttcacatgcattcagaggtgatgaaagattccactggatgctagaacattgtgcataaataatcgaagttgtatgctcttcagcaatgatgctaccccatatcctttttttttctttcccatgatatgaggatatgagtgcagcagaactagctccatgcccttgtcccagaattaatcattcctatccatatttgatgtctttaccttttaaatatttatgggctgttatgttcctttcttgttgttcacccactctggggacattcagaagcctcacatttcttccttagccaaacaccccattcccttcatcctctctcagctgttctttggattacctccaaattgcatacataattttggtattgaggtgccaaaaatgcatttgtttcaactggagttttattgaagttgcttttactcaaatcaagtacacaaataaatttgatttccaaggcatgaaaattcagttaggtctccgaagggaagctgaggtatacttatatttcattataatgctacaggtagattttaagtcactaggaaaatgacatctcaaaatcaaaagattatagaatgagcactatatgaagaattacattttaaagcataggtctgtgatcattttgtaggtttttgttgttactgtcagtctattggtttttattaataattttattgaggtataactgatacacaaacgacatatttaatgtgtacaatttgatgagtttggacatatccgaggactcatgagactgtcactgcaatcaaggtaataaatgtatttattacttccaaaa

SEQ ID NO: 4023 - DNA, 3960 bp, Homo sapiens
  ENST00000453040
aaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcag

SEQ ID NO: 4024 - DNA, 723 bp, Homo sapiens
  ENST00000435603
gagccacagtgtctcagccaggggcagggccggggaactcctgcgaaaaaccacgggccggaggagcagcagccgcgcgggcccagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatac

SEQ ID NO: 4025 - DNA, 555 bp, Homo sapiens
  ENST00000486881
agtgtctcagccaggggcagggccggggaactcctgcgaaaaaccacgggccggaggagcagcagccgcgcgggcccagtaagaagaattgaaaaataattcacagagaattgattcccatgatgcgttcacctatgtcctgctcagaacacatctaggatcatttcagcgctgatagactgttcaaggagatgcagcctaactcaagaaaaattcatcatgctcctcctctttccttctccagttttgttcccacatatgaacattaaatgaaaatttatgaagttcctgctgagtgaaaatcactgctggataggtgaattccaagatgaaatagatagactttctggcctgaagttgcttactgttaccactgaatatatgcccataaaatattaaaatagacctaaatgccttttctgaggtctggaactctcaaagtgttgtgagcctccaatctaattaaagaactcactcaagtataatgcaaaatagaggatgaaaaatgccatacgaatgtatagataatgttttatgggagattagaatagagaa

SEQ ID NO: 4026 - DNA, 594 bp, Homo sapiens
  ENST00000449294
agaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattcc

SEQ ID NO: 4027 - DNA, 462 bp, Homo sapiens
  ENST00000461289
ctaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaa

SEQ ID NO: 4028 - DNA, 399 bp, Homo sapiens
  ENST00000471332
gatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaagtatttttatttcactgttactttgcatgaattgtcacatgggttcagtctgtcttcatttgcccaaatggaataataccatttaagttggagtaccagataaagttctttgaaccgtt

SEQ ID NO: 4029 - DNA, 651 bp, Homo sapiens
  ENST00000470880
gctcaaatggcttaggaagcaggcagctgcagctgtggggctggccgcccctccaccaggagctcggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaaga

SEQ ID NO: 4030 - DNA, 707 bp, Homo sapiens
  ENST00000470005
ggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatat

SEQ ID NO: 4031 - DNA, 1104 bp, Homo sapiens
  ENST00000445697
agtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggaaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactgg

SEQ ID NO: 4032 - DNA, 7311 bp, Homo sapiens
  ENST00000620033
tttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggaaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatcc

SEQ ID NO: 4033 - DNA, 620 bp, Homo sapiens
  ENST00000582692
gggccagtgggaatttatagccaaggagcagtgtgggggtcagtggatggaaaattactcaaaggaagcgttggggtaaggtggatctggctaaacctaacaggattctcactgaagacaggccagggtgatcagacatcacctgggggatggtgcaggatgagaaacctggtcagacattgaggcgatcggatgttgatgttgctggttcttggtaaaacgacttagctagtgtcctttgctaaaactggattttacaaggacgtgcacaaacaggcctagcaggagattcagaagcctgactaaaatttggccaaggaaaaaaatccttgtcaccaggaaagtgaggactattgtcaccaaattcagactgccaattgttaaacatttacctgcacatactgggctcatcttcattattggtaaaatgagctagatgctattttccattagctcacactccaattccaatcgacctgaccatcagaagagacaaaaagggaaaatcctggccagttctcccctacctgatcaaccagtagcataatcagatttgcaagacctcaagaaaagaaacctgaaaatgccactggaggtgtgtgttttgccaaagaaaaaag

SEQ ID NO: 4034 - DNA, 560 bp, Homo sapiens
  ENST00000578605
ttgaggcgatcggatgttgatgttgctggttcttggtaaaacgacttagctagtgtcctttgctaaaactggattttacaaggacgtgcacaaacaggcctagcaggagattcagaagcctgactaaaatttggccaaggaaaaaaatccttgtcaccaggaaagtgaggactattgtcaccaaattcagggagctgcttccacctgtctcctgtgcccttggtttctgctaatcctacattccaagaataaaagtcttcctatgcgttcctaggcagaagccaagtttccctgctttgggcacgttcaaaatagaaggtattttccgcttctcttgcttctgagcacccacgaaatcaacacatccccaaaacacgcgttgagggagtaagggaaagtgtcctgcacccgccaccctcccgcgctaagagcggcagaggaccccacagcttcgtacttccccggaggagctcctggagtaggagacggcttctagcctggaagaaccccgggtgcgacagttgtgccaggaaacttcaagagtattccctcggctgggc

SEQ ID NO: 4035 - DNA, 625 bp, Homo sapiens
  ENST00000606897
tttctctaacattctgttaagatatgtcctgatctcctaaagccacagaatcccagagactcaaagtaaattttctcttcggcaaatcagaaggctctgcataaatactgccaattgttaaacatttacctgcacatactgggctcatcttcattattggtaaaatgagctagatgctattttccattagctcacactccaattccaatcgacctgaccatcagaagagacaaaaagggaaaatcctggccagttctcccctacctgatcaaccagtagcataatcagatttgcaagacctcaagaaaagaaacctgaaaatgccactggaggtgtgtgttttgccaaagaaaaaagaatcaaaaacaaaacctgcaggatgaggacaaacaaacaaagagcagggacagagtctcactatgttgacaccctggacaacactcttgaagtactcttttcccagggaggacacagtcatggcatgcaaggggctcagccatgaaccttgtgatggatgaggaaaagatattctttttctccccttacagtttctggcagccaacatggggtggctgtgacaccccactagttccagaacctgcagatgagatcctgggacaaccaa

SEQ ID NO: 4036 - DNA, 512 bp, Homo sapiens
  ENST00000443025
cccagagactcaaagtaaattttctcttcggcaaatcagaaggctctgcataaatactgccaattgttaaacatttacctgcacatactgggctcatcttcattattggtaaaatgagctagatgctattttccattagctcacactccaattccaatcgacctgaccatcagaagagacaaaaagggaaaatcctggccagttctcccctacctgatcaaccagtagcataatcagatttgcaagacctcaagaaaagaaacctgaaaatgccactggaggtgtgtgttttgccaaagaaaaaagaatcaaaaacaaaacctgcaggatgaggacaaacaaacaaagagcaggggctcagccatgaaccttgtgatggatgaggaaaagatattctttttctccccttacagtttctggcagccaacatggggtggctgtgacaccccactagttccagaacctgcagatgagatcctgggacaaccaataaaaaaacaacaaaaagttaa

SEQ ID NO: 4037 - DNA, 695 bp, Homo sapiens
  ENST00000588769
tctcttcggcaaatcagaaggctctgcataaatactgccaattgttaaacatttacctgcacatactgggctcatcttcattattggtaaaatgagctagatgctattttccattagctcacactccaattccaatcgacctgaccatcagaagagacaaaaagggaaaatcctggccagttctcccctacctgatcaaccagtagcataatcagatttgcaagacctcaagaaaagaaacctgaaaatgccactggaggtgtgtgttttgccaaagaaaaaagaatcaaaaacaaaacctgcaggatgaggacaaacaaacaaagagcagggacagagtctcactatgttgacaccctggacaacactcttgaagtactcttttcccagggaggacacagtcatggcatgcaagacgagataccgatcctcagagaatctaagtgatttgctcaggttcacagttagtaagtggtaaagcaaggaactgaggtgtcggggctcacaacatgataacccaaaataatggcaccttggcacagggctcagccatgaaccttgtgatggatgaggaaaagatattctttttctccccttacagtttctggcagccaacatggggtggctgtgacaccccactagttccagaacctgcagatgagatcctgggacaaccaataaaaaaacaacaaaaa

SEQ ID NO: 4038 - DNA, 989 bp, Homo sapiens
  ENST00000423511
gccatgaaccttgtgatggatgaggaaaagatattctttttctccccttacagtttctggcagccaacatggggtggctgtgacaccccactagttccagaacctgcagatgagatcctgggacaaccaataaaaaaacaacaaaaaggagctgcttccacctgtctcctgtgcccttggtttctgctaatcctacattccaagaataaaagtcttcctatgcgttcctaggcagaagccaagtttccctgctttgggcacgttcaaaatagaaggtattttccgcttctcttgcttctgagcacccacgaaatcaacacatccccaaaacacgcgttgagggagtaagggaaagtgtcctgcacccgccaccctcccgcgctaagagcggcagaggaccccacagcttcgtacttccccggaggagctcctggagtaggagacggcttctagcctggaagaaccccgggtgcgacagttgtgccaggaaacttcaagagtattccctcggctgggcgcacgcagtacatccccaatgctccaatttgaactttgactcggccacgaccaccccactccagtctcactctacggtgctttctcccctgttggtgctgagggcttttgagactacctgccccgcgctccctaagtccgagggaccgaggcgaggacctgtcccgctgagctggcacgacccacgcagggcaggcggcacttacgcggcgcagtcggtgctcctccctgagccgcggcgcgcaaggaccccagccggttgtccttgcagcgcttcccaaatcaggcagaagtgaggcagccccacccagtcacgaggaccctgcagaactcgagcctttaagcgctcctctaggctcacatgacccagacccacagggcaaaaagtgcgtcgtcgtgtcccaacctcctggtcccagaaacctggccgcatcaagtcagcgcttcccatgctggaagaagcaagcagcccc

SEQ ID NO: 4039 - DNA, 578 bp, Homo sapiens
  ENST00000439384
ctcctctaggctcacatgacccagacccacagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcaggacttacttgcaagcccaggatttacatttggaaagcgagtggtgtttgattcccactgtttaaaaaggcaacacacgttcgctgatggtctacattccagctgcactagcaatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaaca

SEQ ID NO: 4040 - DNA, 425 bp, Homo sapiens
  ENST00000461824
ccagacccacagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcaggacttacttgcaagcccaggatttacatttggaaagcgagtggtgtttgattcccactgtttaaaaaggcaacacacgttcgctgatggtctacattccagctgcactagcattcccctgagtgaaatatggcatacattaaccagaagagaaaattacatttattaaaataattaaaacagagtcaaaagaagtaaacgttcaaatgagttttgtaagtttgtagcatttcgacttaagaagttattaaagcttaaaactgcactga

SEQ ID NO: 4041 - DNA, 754 bp, Homo sapiens
  ENST00000474070
acagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcagatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaag

SEQ ID NO: 4042 - DNA, 570 bp, Homo sapiens
  ENST00000470261
ctggtcccagaaacctggccgcatcaagtcagcgcttcccatgctggaagaagcaagcagccccagggtggaatcttaaaaattaatgaagagcatcggcggggtgccattcaggacttacttgcaagcccaggatttacatttggaaagcgagtggtgtttgattcccactgtttaaaaaggcaacacacgttcgctgatggtctacattccagctgcactagcagtaagctcgcaccaagtgccactgtcctgccaagcactctcctgaatcactgcgctggagtctcagagccacctgatgtgttctgtaccattatacccattttgcaattgggggacacaaactaagtgaggttaagtaacccatccagggtcacattgcttgtaagtgacctgagtgtatattattagccaccaccaggtgctgggcatcgagccagacagtacgggagcaagaactaaaaaaggcaaggaggttgcaatggcaagtagataacacaaaataaaggagggtcatcattatcagcaacagcagcgtcaactgccagacaggtgggagaggccacg

SEQ ID NO: 4043 - DNA, 3530 bp, Homo sapiens
  ENST00000222792
ttcttcctttgtgtgtgcgcgagcggagttggggcggagggagaagggggaggtcgctctgtctgtccgtctcccgccgcctctgcccggtctactcgaagtgcggcgggagaggcgggagcccaggagagggtgcgggagctggcggggcggctcggagctgccaggacgccctggtcccagccgcgcacaggggagcgtggacggcagaggggctcggcgggagccgagatccgcccgtcccggctgcccctcggcctccctctgctcccacctaccccctgacacccatagaaaagcgtgcaaaggcgcggagcgggacggaaaccacaaataaatagcggcggcggcagcgcgtcatctggtggagcaggaagtgcaggcagagtccggaggctggtgctttctgcgcgtccccaggactttgccatgggctgggggccgcggaggctgcgagcggccgggcgagggcagcggcggcggcgtccgcaccggggctgagcgagcagcgacgcgaggggcgcgcggagatggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 4044 - DNA, 539 bp, Homo sapiens
  ENST00000409350
gcgaggggcgcgcggagatggcagcgtccagcaactccagcctgtccggctcgtcggtgtcctccgtctattctgaacccagaagcccgagagagcttccaaaatatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccacccta

SEQ ID NO: 4045 - DNA, 547 bp, Homo sapiens
  ENST00000409964
aaatggagaaaaagacatttcaggaagagagaagagcttaggtaaaggcctggagatggtcttggggaagaaaatatatctgtcacggattacaataacctcttaactggctgtttccactcttgcctctcttcagtctattctgaacccagaagcccgagagagcttccaaaatagacgacggctcgatcttggcttgggatcctgtctaggaagatgtcctctctgcacagggagtcagaaaggagatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggt

SEQ ID NO: 4046 - DNA, 740 bp, Homo sapiens
  ENST00000409922
atagatgagattgagcatttggctgtgtgtggacacgcttcatcgtgccaactcaactagccctgggatgccggaggaagaaaatcacaaaaggaaacttaggatgcccaggttccagcacaaaatgcacttcccactgccgaggtgaaactatctgaggcattgaatgaggaacaatacaatttttgagaaagctaaggaggtgcctaccaacccgcaccaacgcatttgtttttgagaaacgtggtgcttatttgcaaatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaac

SEQ ID NO: 4047 - DNA, 575 bp, Homo sapiens
  ENST00000412536
agcaatttggaagcccaaggtgggtggatcgcttgagcccaggagttcaagaccagcctgggcaacatgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggatcaaacgactccatgtgatgtcctggggttaagccccacctctgcctcgttccagtcatataaactcaagcaggaaccgccatctcttcaagcatcagttacctttgcggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgaca

SEQ ID NO: 4048 - DNA, 459 bp, Homo sapiens
  ENST00000478128
aatttggaagcccaaggtgggtggatcgcttgagcccaggagttcaagaccagcctgggcaacatgatgctgaagaataccagcctcctatatggaaatcatacttatatcagttacagcaagaggcacctcgtcccaagagaatcatttgtcctcgggagaaatttaacagcagcatgagttttcccttgatttgattcagttctgttgggtacttcaagctctttgggcttaaaaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtc

SEQ ID NO: 4049 - DNA, 498 bp, Homo sapiens
  ENST00000482820
cccaaggtgggtggatcgcttgagcccaggagttcaagaccagcctgggcaacatgatgctgaagaataccagcctcctatatggaaatcatacttatatcagttacagcaagaggcacctcgtcccaagagaatcatttgtcctcgggaggaggaaatgagacaggaagcacaagaggggcaaaggccagattccaacccagatagttcatatcaatggctgggcttctaatccagtgagtcacggagtgtgatcccagcatcagctgggaacagaaatttaacagcagcatgagttttcccttgatttgattcagttctgttgggtacttcaagctctttgggcttaaaaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctca

SEQ ID NO: 4050 - DNA, 491 bp, Homo sapiens
  ENST00000483081
gatctgccagcttgtgcctgactagtcctgtcaacattgtgaacagtggagatggtttgcctcagttgcactgtgcactgtaaaagcagtaccaatggctgtgcagacattcctaaagagaatcttagttttcttcctccactttaatagtggtcacccagtgggttgagcaaacaaacatttattgagcacctggtgtgtacaagcattcggctctgctttggtgctgaggagagtaaagctgccagggaaaaccgaggggacacacggacagctccagtggggtagctttgcagtgggactcacacctcttcattctaccagaagccagaagatactcactggggacagtcgtgatgggagtttttccatgagcagcaagagctaatgggccgtttgcctacaagagaagatgctgaagaataccagcctcctatatggaaatcatacttatatcagttacagcaagaggcacctcgtcccaagagaat

SEQ ID NO: 4051 - DNA, 2578 bp, Homo sapiens
  ENST00000491856
tatgtgttggaatattggcaatgctgtctgcccctcccactctcctgctgcatgtccctccccccacacccacccccacactcactgccaacccacccgccaacccatccgcaaggctgcccccagggctctttgcccaggccatctgtcccatcctctccaacctggctcaggctgcacaggaggctcctccgcaaagttcctaggtccagtgacctcactatcaaagctccaacacctctgctccaggccccaataaactggcctcccggttccaatccacacctgctatgcagggccagttagaccccctgagactgggctctgcctcagtccctcccaccagaaccggggattcacagaacattcatcctcactcagaagagcattgctccaagacctccagacatcagctgttgagatttaaaatcaaaatttgggaagccagaaagcctttttcttccaggccatcactgccgtacacctttaagaagcgattttgaaacacaaagccacaggctgcttctgacctcactttccttggacagaagcttcagcttggaaggtctactttttaaggatagagggaattaggaaataaatattgtgataggcacttttaaaaatgttatccttctgcatttgtactctaacttaatctttgcattcctgaggaaaatacaaaacaaaagaaaatttgtctagcttacttccctttcctcctcttcaagaaagtaaaggtgtttttctctgtccagaaaatttattctctgatttattatccaaagttctccaaggttggataatcctagaaaggggtgttactcctttcccagaagcttgaagtcccttgggactgcctcatttccccaacccagcttgccccactttccatgaaatactggttgatcaaatctccagtcctgtgggaggagcagctgtatttacttaaaggcaacagggaacgtgggctggttcctgacccaactcctacctctccctattcctctgtggagtcactgtccactctctgggcctcagacaactgcctccacatcagagtgatcatgggccagcacacaaccctcccggatatgccacattttccacatgcatgtgtatgggttttaaaatggtagagaagataaatttatctttaaaaaagaaaaataggtacattttctaaaatacccataagctattgctctccaagtgtaaataactggaagaatgttgatgatagctacctctttccagaaaatgagcctctaaaattaacaccaccctgcacctgaagcaagcaggttgctaatcaataaatgtccacttgcaattaggataacacatagttctctgagctgagagctaaattggtaattgctcttctgttatttcccatggttaaaaaaaagggggggggggggcggtggttgagtaacctggctttttgtttcaactttcattttcaacttgaaagcaaagacaatagcagaaagccaggtggactgggcatccttccttttgtttgcctgcttgaatacttgtgtttggagcatgtgaggggtggttccaagtcacttaagatgggcagtagtcaccccccttcttcactcagttgtggggctgtcgattctgggtgcccccaccatccttttaaggctagttctttgtggtccttattctgtatgtggtctgttcagagcattgatggtcttgtaccttcaggtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaaggtgagctgtgtgtgatggaagcagcctttcgttttaatccatgccgcatcaacaggcgggttaactataggtgcgatttgctgaaatgttggaggagacccacccccacccgaagaactctagaatgttagggccaaagggaccttagaaatcttctagctcaggccgggcgtggtggctcatgcctgtaatctctttgggaggccgaggcaggtggatcacgaggtcaggagatagagaccatcctggctaacacggtgaaaccccgtctctacaaaaaatacaaaaaatcagccgggtgtggtggtgggcgcctgtagtcccagttacttgggaggctgaggcaggagaatggcatgaacccaggacggggagcttgcagtgagccaagattgtgccactgcactccagtctgggcaacagagcgagactccgtctcaaaaaaaaaaaaaa

SEQ ID NO: 4052 - DNA, 542 bp, Homo sapiens
  ENST00000446446
aaccccatctatgaacacattggatatgccaccctactcagagaaaaagtatccagaaggctgagcaggtctaaaaatgaaccaagaaaaacaaacgtcacacatgaagaacacacagcggtggaaaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtattt

SEQ ID NO: 4053 - DNA, 2991 bp, Homo sapiens
  ENST00000412711
gtgtgtttgagtgtgaaatgtgctaataaggaggagagacctctcctttgcaatgtgctgcggcaggagaaagcaggctgccggcccctgcctccctgaatcctcagtggctgactggataccgcttctgggggttgctgtgcacatgaatgtttgctattgttccaggcgcacgtcggccttaagaaatagcacaaaacaggcccatccttattcagaagccgggccccctccatcactcaaactgggcctttcaggtcacatgccggaggctgctgcagacaggacccagctgcctcaaatctgccgcctaacataagctgcggttcgaaaatcctgacagcacagggcttcctgggctctgcagagcaaactggaaagagctgggatccaggcactatgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 4054 - DNA, 687 bp, Homo sapiens
  ENST00000467441
atcactcaaactgggcctttcaggtcacatgccggaggctgctgcagacaggacccagctgcctcaaatctgccgcctaacataagctgcggttcgaaaatcctgacagcacagggcttcctgggctctgcagagcaaactggaaagagctgggatccaggcactatgttctctgaagaactgtggctggaaaatgagaaaaagtgtgctgtggttcggaagtctaagcagggcaggaaacgccaagaactgctggccgtagccttcggggtgaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtat

SEQ ID NO: 4055 - DNA, 552 bp, Homo sapiens
  ENST00000493906
aaatctgccgcctaacataagctgcggttcgaaaatcctgacagcacagggcttcctgggctctgcagagcaaactggaaagagctgggatccaggcactatgttctctgaagaactgtggctggaaaatgagaaaaaatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacaga

SEQ ID NO: 4056 - DNA, 918 bp, Homo sapiens
  ENST00000410098
acagtgctgaggtagctttagcccgcatagtactcctggccacaccatgttcttccaaagagctcagctctctctgcctcagttccctcatctataaaatgggagtgttgggaggtttaaagaatacatgcgagtcacttatcgtggtctctggcacccagtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccat

SEQ ID NO: 4057 - DNA, 546 bp, Homo sapiens
  ENST00000433720
aagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaagtaagctcatgtctcgtgcacaaagcctgctctgctcctagagcggttaatgcatgaggaaaagtggacggcattcctccccagccataactgctggagtttcactgtgccaggaaccactccaggcactttcagtgtatcatccctatgaaaggggcgccactgtgatggctcacgcctgtaatcccagcactttgggaggccgaggtgggcggatcatgaggtcaggagattgagaccatcctggctaacacggtgaaaccctgtctctacta

SEQ ID NO: 4058 - DNA, 755 bp, Homo sapiens
  ENST00000439711
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 4059 - DNA, 825 bp, Homo sapiens
  ENST00000421775
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 4060 - DNA, 2279 bp, Homo sapiens
  ENST00000424025
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcaggattaaaatcggaaggcctttacagagtctctgggttcactgaacacattgaagatgtcaaaatggcatttgacagagaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatt

SEQ ID NO: 4061 - DNA, 2375 bp, Homo sapiens
  ENST00000409041
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagagaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatt

SEQ ID NO: 4062 - DNA, 725 bp, Homo sapiens
  ENST00000495789
atggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaggacagcaccctgaccaccctgcatgatatgcggtaccaaaagctgattgtgcagattttaatagaaaacgaagacgttttattctaa

SEQ ID NO: 4063 - DNA, 2421 bp, Homo sapiens
  ENST00000400128
ctgtggtgtttttcccccgctcctctggctgccttcctgatggatctctgtggtcccaggcaggaatggcctgcttggggacccagcgagctcccaaggcctttcctgctgcttcctctatccctgtgttttgcttggctctctaaattgactcagctccaggacatcaggaccccaggttctctggtcttgggactctgagacttgcaccaggaatcctgcccaggctctcaggcctttggactcagactgagctacttcactggctttcctggttctccagcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 4064 - DNA, 2036 bp, Homo sapiens
  ENST00000400131
gcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 4065 - DNA, 2136 bp, Homo sapiens
  ENST00000400135
gcttgaagatggcagatcgtgggacttctcagcctccataattgagtgagccaattccctgaatacaacaagaagatgcccatctgtagaccaggaggtggtccctccccagaaactggatgggccagcacgttgattctgaacttctagcctccagaactgccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 4066 - DNA, 2239 bp, Homo sapiens
  ENST00000400127
gcttgaagatggcagatcgtgggacttctcagcctccataattgagtgagccaattccctgaatacaacaagaagatgcccatctgtagaccaggaggtggtccctccccagaaactggatgggccagcacgttgattctgaacttctagcctccagaactgccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 4067 - DNA, 2548 bp, Homo sapiens
  ENST00000299295
gctgctgctgtgatccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 4068 - DNA, 1637 bp, Homo sapiens
  ENST00000543733
gcacactgcgttccaagttggggacttcccagaaaatgaagtcagctggagttgggccgaggtatacttggtaatgactgcaggttcggcacacagccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtc

SEQ ID NO: 4069 - DNA, 1974 bp, Homo sapiens
  ENST00000338326
ttttcaggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctg

SEQ ID NO: 4070 - DNA, 2654 bp, Homo sapiens
  ENST00000320585
atgagagggcggggcggccactttgctgcaggagatacccaaagccagttagcactgaggaagtcagaagagaattgtcagtctctcggacaccttcattttctgccccggaaatttctcctccgctgttgtctgggctccacttccgacccccagttgctaccagctgtagtccgacctatcgtggcccgggctagtgccagcctcccgccgctacctccgcctcgtcccttctcctctgcgcctgcgcgaccggaaaattcgcgaaggttcctgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttttggagtttttttttaaagtcatgaagagcttcacaattctagtgatacaatgttgactatatattgtactttatattaaatataggtaatacagaattagatcgtttggataggttttgagttagtgcagaactcaagaagaaaaattaggaaatattctgaaggccagaactctggaagaacttagaaagtttgggaataaattaaacttatgtagatttaaaattaaaaggggtttatttcccaaaccccttgagtcttttcttttccttggtatttatggaattc

SEQ ID NO: 4071 - DNA, 1698 bp, Homo sapiens
  ENST00000529987
cctcaaaagaagaagaaatgtgtcatatatcaatttggggatataagcaaatcctagtcacagtcgttttctaaaaagtattgttttctggaaaaacctagtttttaagaatgatgccacagcgaagttctattttaactttttaatttgatttttttttctttgttacagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttttgga

SEQ ID NO: 4072 - DNA, 5361 bp, Homo sapiens
  ENST00000533724
gaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaaggtatactttatacagttacatatttttgtcacacttgaatagtagcacttgtgcatggtactttcctttatgatttagcatgataccatttgtagctactatgtaggccaccaagctttgaaccatttggtttctcccttaaatctgccttaaatttttatttctcttcaacttgagagcatgtacacaatataactacataacagatttgcatattgtactgtcataattacagggacatgtatcatcagggtagggaagtcacatttttcttgtgccttagagtgcatctttttcactgtggcatggtaaaattctttgaagcagttttccttttcatggcatgagtttgaagtagaaaataatgcagaggcctaatcatccatctttactttcagatgcctgaaaactaccgttaatctcattactactggtcaatttttaatgcatttgatttagatgacatatttgtgaaagtagtcttaaaaaagcgtttgctcattgtgcaatagagttgtacagattcttcatacttgccttctgataaccagactctgtattcccacacatgtatattgagtacctttgttgaaccaggtcttcttcgtgctacacttgagtactaaattgttttagaagcaaactacaggacttaaaaaaaggtgatttttttttttttttttggctgcaagtaggcacttattgtaatttttattcatgctatgaactcatgattttccctttattctcctttgatcctacttaaataaatttatagagtattgaataatatagaaccaagataagaaccctaagagactttagatgtttatttgttcattagcactctgagtacagattattgctaaggaaactactcaggatgattttattctctctccatcttcatagttagaggagaccattgaatgctttggccagtttagcagttagaaaaataattgggaaaagacaaaacttcagtcatggctcattcttaatctctttagtaatataatacagtctgtactataatagtatgagttaattttttctttaaatgatgggctgttattttacttaaagggcagtgagaggccaggcactgtggctcaagcccataatccagcactttgagaagcctaggagggaggatcctttgagcctaggagtttgagaaccaatctgaaagagatcctgtctctccaaaaaaaataaattagctgggtttggtggtgtgctcatgtagttgcagctactcaggctgaggcaggaggatcttgagattgactttttgaaaaaaaaggacaaaggcagtgagatgagaaaaactaaatattttatcctaaattcatttggtggtattataacaattatgaggatatcagtttttacatacttttcttttttttaagaagaaaagtccctctcttacccaggctgtaatgcagtggcattatagctcactgcagcctttaactcctgggctcaagccatcctcctccctaaccctccccggaactataggtgtatgctactatgactgtattagtccattttcacagttacgaagaaacacccgagactaagtgatttataaagaaaaagaggtttaatgaactcacagttccatatggctggggaggcctcacaatcatggcagaaggtagagcgagtaataaaggaatgttttacatggtggcaggcaagaaaaaaaccatcagaacttctgagacttattcactatcatgagaacagcatgggaaaaaggcatccccatgatccagttacctcccactaggtctgtcacacaccatgtggagattaggggagctagaattcaagatgagatttggttggtgacacagggaaaccatatcagtgaccgactaatattttttattattttgcggagacagggttccactttgttgcccaggcttcaagcagtcctcttgcctcagcctcccaaagtgttgggattatgggcataagcgaccatgccttgcctatgtacttttaaaatgcctcttttgtcagttttttcatcgaggatatagaatgaatagcctacgatttttatttttattgctgtgtttattaatatgtttaatacttatttattgagtggacttaaattatgtatacaacacttagccattatgaaatgttagaagatgttgttttttaaaccctactgaaattgccttgcaatacgatcgtatctgaatttacagatccatatgccagtgtccacataaattatctccactggtagaagtgagtatggattcacttagaacttacttatatttcatgtttattatgtgctcagcattgagcttgggcatgggatgtaaaagtacattatggtcccttcctcagcattactcatcttgaaaaccttggattcctagtctttattcctttctcgttagtgcaactgattaatacttaaatatgctgacaatagcgtgattatttgagacttactattctaatataaggagcttttctgttaagacagaatgtagatacattgtaacaattatttataaaataccttttaaccttttaatgggaatcatttgatacacaaagcatttggcttctcagaaagcttttaaggttattaatttggagtacaaagaaatattttggtatattaataatggtaataaggtttcaaaattctccagcccagatgaaccaatgacaaatttggaattaaaaatatctgcctccctaaaacaagcacttgataaacttaaactgtcatcagggaatgaagaaaataagaaaggtaagattttattttgttttattgttaattattttctggtacagttaagcagttatccaaaagagagaatagtagtttactgcatataaatagggaaaagtcgcacattgtagttaagaaactttttcttctaaatgtcagatatgataaactacaaatacttcagaacctaataggttaattccatatgtctttattcaaaacgagaacctatattaaattttttttcttttatggttcattatttttttaagaatcagctaaatttctttgatattttaaaatgttttcttgtacattatacaaaatatattcactattctctgactttatacctggtaccatgggaggaaaacaccctttcatgatttattttacaaagttaagatactggatataacattttgttatggaaaaaattgtgtcctgcattgttgaagacaccaggtcctcaaaagaagaagaaatgtgtcatatatcaatttggggatataagcaaatcctagtcacagtcgttttctaaaaagtattgttttctggaaaaacctagtttttaagaatgatgccacagcgaagttctattttaactttttaatttgatttttttttctttgttacagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 4073 - DNA, 2003 bp, Homo sapiens
  ENST00000457199
tagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 4074 - DNA, 4805 bp, Homo sapiens
  ENST00000529726
agtgcgtgtagaatgaatgatagaatttgaaagtacagaaagtacagatggttccgaacttaccatggtgtaacttaagatttttttgacttaacaatggtattatcaggctataaccacattgtaagcaaaggagcatctgcctgtattagcaggatttgctaatggattcgatgtgaagggaattcaagcatctgggtgattggtgacaccattaaccaacaaggtgaaaatggggtgggggcaggtttatactttttcctcatgttaaattttagatcacttaaggaatggagatacaattgtatttacatgtatatgaggtagaagtagtagataaaagggaattagtaattactggattggggaaggcagtgcaaatggtagggtaatagaggaagatcaaggagaaggtatcagatgtgttttgaaaagtgaatgacagggaaaacagagaaagggtatttcaagcgtaagtaatagcacaagtatagagaaaattatgtaatggtacaaatttgctgctgtggaattgagattaatagagataagtagacctggccagatcctaaaagggtttagtgatgcagggaagttagattgtacgttagagtgtggaggccattgaaattgaagaattttttagtctttttcattgaaatataacattgaagtttgttaaaggatatacaaatataaatttgtagctcaagggattttcacaaaattaaacacaccagcaatgcagagcactccttatgtgttttctcattcattatcttcctcaaatgtttttctgtcagtcaacatatgttttttctgtttctgagtttaatgtaaaaataaccatagaatatgtacttgtttttgtcgtcttctgcataataatgcttgttttatttatctttgttgcatgtagctttagttttgtttttttatttctttaaggtatgtcattatttgaatgtgccacaactaatttctactttatattgtcctttaattttaaaaaattgtttttaataatgctattatgaacattctttttgagatggagtttcactcttgtaacccaccctggagtacaatggtaggctctcggctcactacaacctccgcctcccgggttcaagcgattcttctgtttcagcctcctgagtagctgggtttacaggtgcccaccacgcctgactaatttttgtatttttactagagacaaggtttcaccatgttggccaggctggtctcaaactcctgaacctcaggtgatccacccgcctcggcctcccaaagtgctggaattacaggcgtgaagccaccgcagccggcctattatgaacattcttgtgcatgacttttgtgacacatatacacatttccatttctagtattttggatttttttttttaaattttggcatatgtgcattatacttatcagttagttcagcatccctaatctgaaatgctccaatgagcattttctttaactgtcatgttggctctcaaaaagttaacagatttttggagcatttgagattttggattaggtatgcccacctgtatatctttagcattaacagatacttccacatagttttccaaggtggttgtatttgtttacgtttctaccagcagtatgtgaggctagttcaacttgtcctatggtttcttaacattttgttatacgagttttttttgtttttttttttttttttgtattttaaccattctagtgtgtgtatagtgttttgtcatggttttgatttgtacttccctaatgatgactgcttttttgtatgtttattagccatttgtatatcctcttgtgaagtgtgcagaatcttttacctatctctaatgtctcttgcttaccagtttgtaagaattctttatatattttagctgtgactcttatcagaaattctatgctttttcactgtcttaatgacgactttgataaactttttatcaaattgctttttaacaaaatccaatttgtccatcattttgtttatgactagtgctttccatgttctatttaagaaatcgttgcttacttcagggctgtgagtgttttctcatatggaggcacatttaaatatgtaaatgacctggaactgattattgtataaggtgtgacatggatgtaattaaagaactttaaacaaaagggtgatagtaatttgataattagtagaaaatagaagtcgaaggctgagaaatagtagaaacctgttagtatagtctgattgcttaaaatctgctagcttatgaggaagattaacaaattaatatattcaagtcaaattgatgagatttcattatagactgcctatgggtggagggagaggagatgctgaagaggaacgaatggattttgctttgagaaactgagtctgtacggtgccatcaaataatatggggaaaagaatggactgtgggggcaatagcattaagtttagtagatgctaacatactgagttttatgttcttgtgaaatatcttaaggagaaatacacatctaatactgtactttggatttataaaagataaacacagaattttattttctgtttgtaggtagtgctataaatacaaaaatagaaaatatactactggctacatccatgttttattaacataattttttgtgaattcatctgtagagcctccatctacagcagcaatggggcccggatcttccagacaaaccctggatatatatataggtctgcagctcattttaccctttatagggataagaaatcaccatcactctagaacttccagaattgcttattagatttctcatattatttgacaatacttacatggagtttactgtacacataagtcatgcagtaactgtatttttattgagagtattaatcccttggtttcaacattgtttttgaaattagtaactaagtaagtacttgaatatgattggatgggatctcatactcaaaaggctgaaagcatcttaatatgactttctcaaaggaacctaaaacttaaccaagtccaaaagggaatcatttttcattttttaacagaatggcgtgggatggatttatgaattttctaggtaattgtcatttaagtattttgcaaagttcgtagaggtcaccaatactgcaaatatgtatgagatgtaactgtaagatacgcagctaattttttttctctttgtttcctttttagacataccagggtctagagagtctagaagaagtctgtgtatatcattctggagtacctattttccatgaggggtaacttatgcatgacttattaaaatagtttatggtagaatttagaaagttaaacctttctgtctttaaacattgtttgccatgcagtgttattaggcattttacttacattgccattaacatcttcacaatagcctacacaaacacaggggtttgtatgttgtgtgtttatacatgagaaaacagaaacaaggttacagttcttaagtggtcattgtgatataaactgcctgtttttcttcatattctgtatttaaaagtgatgctatttgggctaaatgttttgtttgaaggactgtcctacacattgcagggcatttagaattttgggccctggggcactaagacaacattatcccaagacgacccatacttttccgcatcctgcagttgagagcctctcttctgtattatgctctagtttatagaaatgcagcactgtgtaaaaatcttccactctgtttccacattcttcctgatatactgtacattcatttttagtaacttagacacttgtaaaatgctagagtttgtacacttactggcttattaaaaatcagatttatccctaaaatacttgtggatttaattggttgtgagattttatttctgaagtttttctgtgataatttaaaggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctg

SEQ ID NO: 4075 - DNA, 1136 bp, Homo sapiens
  ENST00000525317
gcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagagcctccatctacagcagcaatggggcccggatcttccagacaaaccctggatatatatatagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagatt

SEQ ID NO: 4076 - DNA, 566 bp, Homo sapiens
  ENST00000533772
agtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaaggtttcaaaattctccagcccagatgaaccaatgacaaatttggaattaaaaatatctgcctccctaaaacaagcacttgataaacttaaactgtcatcagggaatgaagaaaataagaaagaagacaatgatgaaattaaga

SEQ ID NO: 4077 - DNA, 564 bp, Homo sapiens
  ENST00000530765
atcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaaggtcttcttcgtgctacacttgagtactaaattgttttagaagcaaactacaggacttaaaaaaaggtgatttttttttttttttttggctgcaagtaggcacttattgtaat

SEQ ID NO: 4078 - DNA, 575 bp, Homo sapiens
  ENST00000533062
tccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagtcctagactttccaagattattggatttcacagtccagaagatttcagacaaaatgcgtatacatcaatacagggatactagttgaccaaggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaaggtatactttatacagttacatatttttgtcacacttgaa

SEQ ID NO: 4079 - DNA, 809 bp, Homo sapiens
  ENST00000529402
ttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacggtaagaggaacgcgccgccagccctccctcccctccacctcatcagcaggggaggccctttgggccggagggtgtccgcggatctcctgcagccgtcctcgcgcggccccaggtccatgcccctcctgggcctcccttggctgcccgcgcagcccgccggccgcccctctgttgcgccgcgttcccttggcgagcgcccggccccggcgcctgactgtcctctgccactgcggagagagacgctcccatggatccacgtgtttcccccgtcgtccccgcactccttttaagtcgcctggaatttagaacgaacacgtttctcctctggccctccagtctctggggaagcaaaaattaacgagatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaag

SEQ ID NO: 4080 - DNA, 582 bp, Homo sapiens
  ENST00000533739
gctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaaggtaggaactatattttcatttttttcatatctgtgtagtaaattgagagatgtaatactaaatctttattttctcatctttttttctcagctagtgactttcttcttaatgacctttgcgggggaggtgctttaagcgtatactccactaaagacaaagaaaagacagtagatgatgatcttaaggtcttttccagttataaaattgtattttaattctgggtttttttttttttttttgagatggagtttcactgtgttgcccaggtggagtgcagtggtgcgatctcagctcactgcaacgtccgcctcctgggttcaagcgattctgcctcagcctcctgaggagccgggattacaggcacctgccaccatgcccagctaatttt

SEQ ID NO: 4081 - DNA, 1252 bp, Homo sapiens
  ENST00000356534
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgggaccttgaggcccagagagatgaagtagcttgtctagggtcacgcagcttcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttcc

SEQ ID NO: 4082 - DNA, 3521 bp, Homo sapiens
  ENST00000204604
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 4083 - DNA, 3547 bp, Homo sapiens
  ENST00000448472
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgacagggaccttgaggcccagagagatgaagtagcttgtctagggtcacgcagcttcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtggggattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 4084 - DNA, 3492 bp, Homo sapiens
  ENST00000420973
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtggggattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 4085 - DNA, 4719 bp, Homo sapiens
  ENST00000460627
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtgagatgatgccatttatgagcacttgcccagtctgggcactgtgccgagagcatgctctgcattgcctcccgtggtcctcaccacagcccagtgggaggaaggcactgacattatgatgcccattttacagaagggggaactgaggctcagtaggataatgtgatttgttcaaggtcacacagctagtaagtggtgcagccaggattggaacccaagcatctggctccagcgttctttcttaagcttcctagggcaccctggaggttcctttccatgttcctttttcataagccctgcctgggcatcctaattggcctagcctgcacagtgtctgagcgtagggccttcttgtctctctgctccaggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcaggtagggagcaaagagccccgggcgtgaagttctgagtcttctctatcacccaggaaagggggggagggtttctgacgggctctcatcatcgtcccttccccagagaccttcagtgccatcctgactctagaaggccccccacagcagggcgtagggggcatcaccctgctcactctcagtgacacagaggactccttgcattttttgctgctcttccgagggctgctggaacccaggagtgggggtaagtgggatgggggcaaaacacgtgagaaggttagggagagcacctgtctcagaaaggcccacatgtgcggccttgcaggactaacccaggttcccttgaggctccagattctacaccaggggcagctactgcgagaacttcaggccaatgtctcagcccaggtgagtggggatctggctctcgctgccacctgtcttggcctcttgctattgcccatcacaccctgctctgtccccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacggtgaggcggggggggggcctggtgcgccgggcatgcacaactgagagacacagacaagtgccagggtgggtgtgggagagatcctgtggactgggggtgtaagcggccatggggtaaacctagcctcacctgtcttgcccctccgtagtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtaggtggcgagtgtgggcagtgggggcagtggggagggtgcagagttggaggggcactgtgtgccattgcactagtcacttgctgtctctgagtcctgggggtggtcgtatcacagcgcccccccggctggtggggaggatgagctacatgaggaggctggcagcccggcaccctatccctggcagctgagatgattgtggagcgaatggcatcctcctgggccactgcagcgctcagggggccgaggtgtctcctgctggctggccagctgccgctggtaaagacgcgagggggagccccagcgctgcctcagttggcctctcctcccaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccaggtaggaggtcctggaagggcacactgggtcctgggatctggagcaaggggcctggacactcccgtcaatgcctctgctcctctctgcagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 4086 - DNA, 3384 bp, Homo sapiens
  ENST00000450923
cccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggcccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 4087 - DNA, 3155 bp, Homo sapiens
  ENST00000348986
atgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 4088 - DNA, 4234 bp, Homo sapiens
  ENST00000470150
gccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggtaagtgggatgggggcaaaacacgtgagaaggttagggagagcacctgtctcagaaaggcccacatgtgcggccttgcaggactaacccaggttcccttgaggctccagattctacaccaggggcagctactgcgagaacttcaggccaatgtctcagcccaggtgagtggggatctggctctcgctgccacctgtcttggcctcttgctattgcccatcacaccctgctctgtccccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtctttgggcatgaggttggctctttgtggccaggaacctgagtggggcctggtggagaaggggcagagagtaggaggtgagagagaggagctctgacacttggggagctgaaagagacctggagaggcagaggatagcgtggcagttggctggcatgcctgggttccgcagaggggctggggatggttcttgagatggtctagagactcaagaatttagggaagtagaagcaggattttgactcaagtttagtttcccacatcgctggcctgtttgctgacttcatgtttgaagttgctccagagagagaatcaaaggtgtcaccagcccctctctccctccttcccttcccttccctttctttccctcccctcccctcccctcccctcccctcccctcccctccccttcccttcactctcccttccctctcccttcccttcccttctccttcgttcacagcaatggggtcttgctatgttgcccaggctggtcttgaactcctggcctcaagtgatcctcctgccttggccttccaaagtgttgggattacaggcatgagccaccacacccagcccagcctctaccttctttgtctaaagtgaggcaaacacttttctgtttttttcctggaaactcgtgttctggaccagttctggggcaaactggggtcagagtggattggaatcagctctgatccagcttttggctgtgcttaccttgagaccaaatcatgtagagaataagacaagaccctcctgccctgttaccctcttctctctcccctccctcattcctaccatcaagacccaggcattttgacaagctctaggaaatgagggtatcagaacagaaatctaacaaatgtatgtagctgcagatccatctttcatataaacaatgtggagtc

SEQ ID NO: 4089 - DNA, 588 bp, Homo sapiens
  ENST00000496527
gctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcggtgagtgcaccccgcggccggcccgggccctggcgggtggggagcgccgggtcgcgcgggcgtcggagtggactcggagctgctgagaaggagcccagtcggcagatgttggggatatttttctggtggaggaaggggaatcagcccctccaattcttaggtgctgttactgatcgcccactctgtgtgaggctctgtgccaactccgtttcgttccctgctcatctaactctcatggcagccttgctagatagagagtattattatccccattttccagacagggaccttgaggcccagagagatgaagtagcttgtctagggtcacgcagcttgtaagtggcagagctggctgactctgcggg

SEQ ID NO: 4090 - DNA, 503 bp, Homo sapiens
  ENST00000459711
ttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacgggtagggggctggcgaacagcggggttgtggttgaggctgggccaccaaagcggcgtttgacagtgctcaggccatcttcctcccgtcccagacttcgtggcgctgctgacagggccgaggtcgca

SEQ ID NO: 4091 - DNA, 568 bp, Homo sapiens
  ENST00000485883
gcgggcagcccccggggcggcacacggcgcgagctgggcagcggcctccagccaagcccgtccccgcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactc

SEQ ID NO: 4092 - DNA, 608 bp, Homo sapiens
  ENST00000482805
gtgccaactccgtttcgttccctgctcatctaactctcatggcagccttgctagatagagagtattattatccccattttccagacagggaccttgaggcccagagagatgaagtagcttgtctagggtcacgcagcttcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtgagatgatgccatttatgag

SEQ ID NO: 4093 - DNA, 546 bp, Homo sapiens
  ENST00000486066
atctaactctcatggcagccttgctagatagagagtattattatccccattttccagacagggaccttgaggcccagagagatgaagtagcttgtctagggtcacgcagcttcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggtgagaaaggggaaggagcaaggaggggtcagctgccggggcccgggagggaaactgggagagctgggaggggct

SEQ ID NO: 4094 - DNA, 677 bp, Homo sapiens
  ENST00000461684
atctaactctcatggcagccttgctagatagagagtattattatccccattttccagacagggaccttgaggcccagagagatgaagtagcttgtctagggtcacgcagcttgtaagtggcagagctggctgactctgcgggacatccttgcctgggggggtctcatcagttggcatcttgcactcacttgggtttcccgccttttccgggagcagcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtgagatgatgcca

SEQ ID NO: 4095 - DNA, 560 bp, Homo sapiens
  ENST00000482014
gatactaggtcccgggccacttggatggggcgtcggactggcctttcccatggccagctgaagcccgtgttcttacccccccgcccgcagagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtgagatgatgccatttatgagcacttgcccagtctgggcactgtgccgagagcatgctctgcattgcctcccgtggtcctcaccacagcccagtgggaggaaggcactgacattatgatgcccattttacagaagggggaactgaggctcag

SEQ ID NO: 4096 - DNA, 683 bp, Homo sapiens
  ENST00000461120
attttacagaagggggaactgaggctcagtaggataatgtgatttgttcaaggtcacacagctagtaagtggtgcagccaggattggaacccaagcatctggctccagcgttctttcttaagcttcctagggcaccctggaggttcctttccatgttcctttttcataagccctgcctgggcatcctaattggcctagcctgcacagtgtctgagcgtagggccttcttgtctctctgctccaggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggtaagtgggatgggggcaaaacacgtgagaaggttagggagagcacctgtctcagaaaggcccacatgtgcggccttgcaggactaacccaggttcccttgaggctccagattctacaccaggggcagctactgcgagaacttcaggccaatgtct

SEQ ID NO: 4097 - DNA, 1340 bp, Homo sapiens
  ENST00000464833
cctaagctccggttgccatctgaaggtggggacatatagggtggccctgctggcggactcttcctgttgctgaggttcaagggtctaaaacttgctgctctccaggccctggacctatggacagtgtcttccagctcgtggaatgtgtgctggggagctgggaatgctgggtttgagggcttgccctaggccaccttctcacctgtcatctctcctctgtctggacccagcgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtaggtggcgagtgtgggcagtgggggcagtggggagggtgcagagttggaggggcactgtgtgccattgcactagtcacttgctgtctctgagtcctgggggtggtcgtatcacagcgcccccccggctggtggggaggatgagctacatgaggaggctggcagcccggcaccctatccctggcagctgagatgattgtggagcgaatggcatcctcctgggccactgcagcgctcagggggccgaggtgtctcctgctggctggccagctgccgctggtaaagacgcgagggggagccccagcgctgcctcagttggcctctcctcccaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctg

SEQ ID NO: 4098 - DNA, 2964 bp, Homo sapiens
  ENST00000306960
agtgtgcctttgtgagggtgtgtgtgccgccgggtctgtgcagtgggtgtgggtgtttgtctccctgtatccgccttctctcccgtccgggacttttagccttcctgggctcgccttcctcatgtcctttctcctccctcttggggctcaaattgggtgccctggtgaaggaggggggcacactccagaacctagtccaaccccagacgctgcctgaggcttccctccagctcccctcccttccttttctccctttcctccctccctctctttccctttctccctccccgctaaggctggcgtgccagggggtgggacatgccaatcactggctgtgcctctcccgctgccagcacagggcgcagctccccctgggagccaggtgtttgggtccctggagacgccgcaggcccccagggaggcagtggggctgaggaccctacagacccctcttcagccccgtggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccccgggaaaggccggtgggaagagggcaggggctgcatcctcagccccagggccctgctcaggcctcacctggcttcccaggaccctgggtcaccttcctgggcagcccagagagaccctgccaactttccagacttcgctattcccaggcagggagggaaacccggggaactggtttttctgttccctgctgggtgggaatgcgctcttcaccaggaagaaggcccgggaggaggatccgggctttggactccttgtttgcctttaggcaggaagtcaggagccagcagggcgggccaggagaaagaaggcttaacattaagtattccttggcccagcagcggcccagattgcggtgtgagatggtgccccctggggggcacagccagaaactgaactggccgctgggagaaaagccagatgacagggagctggggaatcccctcgcttcataggcagagcccgcccacctgggccctaggcatactctccaggattgtccacaaatgtcctcagagggtccctaggtgggtcaactccaaggcaaatgtccaagcatcagcaagacaatgacactggaagggtccggcttggctagtcacatatcaagtcccgaggcagcaacaggaccaggagccaggtgtcctgactgtcctacaatatcattttcctgggagtgggagtcaagtgtgcctgctatccagccgcaaatccataccccctgccccagagaagcctcagtccctccctcctggctcacagccaccacctggatggatctgctccatgcagatctagccaggcctcccgcatgctgcctgcctccggccctgccccacacaggcctggcccagccagcaggttctctcctgtgagctccccaatccaacccatgcatggcctcccagccacccggatctccaggcccagcctggccccaaatgttctttcctttcatcctcagcaagtgctgagtctgtgaataaagccacataaccagcgggca

SEQ ID NO: 4099 - DNA, 2123 bp, Homo sapiens
  ENST00000543973
atgtgcaggggggagggcgtgtgtgcgagggaagcaggcatgtgaataccagggcatgtgtgttggggcatggtgcacaggggctgggggctctaaggttgggtggggggaggagcccaaggaaacagtgtgcctttgtgagggtgtgtgtgccgccgggtctgtgcagtgggtgtgggtgtttgtctccctgtatccgccttctctcccgtccgggacttttagccttcctgggctcgccttcctcatgtcctttctcctccctcttggggctcaaattgggtgccctggtgaaggaggggggcacactccagaacctagtccaaccccagacgctgcctgaggcttccctccagctcccctcccttccttttctccctttcctccctccctctctttccctttctccctccccgctaaggctggcgtgccagggggtgggacatgccaatcactggctgtgcctctcccgctgccagcacagggcgcagctccccctgggagccaggtgtttgggtccctggagacgccgcaggcccccagggaggcagtggggctgaggaccctacagacccctcttcagccccgtgggcaccctgaaacccaccacccccgtccacctcagctcccccaagatggactgaatcaggctgctggccagatagagaagctagaagccaaggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgca

SEQ ID NO: 4100 - DNA, 549 bp, Homo sapiens
  ENST00000536524
cggtggcaagaatcaggttccaattctctggaacctctggtgacttctctacctgccacctgccccaggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtg

SEQ ID NO: 4101 - DNA, 2005 bp, Homo sapiens
  ENST00000468573
attacaccagctctctcagtccggggaggaggaggagcaggaggaacgcgaggaggaaggagaggaggagcggccagcagtagccacgaccgccaccaccaggcagaggaagagttcgtggggaggaaaagacctctcctcccccttggagcgccttctctctgcttttggagaaagggaatacacgataaagaaggagacggaaagaagagaaaaagtgaggcgggagacagagggaaaagggcgtgaacagaaagggccggagcgtgcaggggagcacagggcgcgggggcggcactgccgagccgggagcgctgccgcttgggcaggtgccgcggccgctgcccggaggcggcatgtgacgcgcggccgcagctgcccgcgggcggagcgctctcagaccccggagcgcacaccgcggggccatcggtgccatcgcggatctccaggctcctcatcagtccgccggggccgcagcagcgcttctgggaagacgggcgatgaactgaagggcggctccgggcaggggggcacgatcttaaggacagtcgctccctgaacgcggagccggaggagacgaagggaaggtggagcggacgccacccgcgcaccgggcaggcgcggagaccggcgtgggacagccacctggagcgcagctgccagaaagaaggactttgctgctttgggccaggatctgaacttaggtgtaaaccattgccctggcagagggaacctacccagtccattgctgcctgctacaagatatgaacagtaatggcacatattttggttatgagtcactcagaggactgtggattgaatgaactgtatccatccccatcatgatgtacagaaccaagtctcttcactacacttgtgttctgattagtggccaaataaatgacagtcagaacttcagctaaggtacaataaggttttgctgtggcgtggcacctggtctctttctagaaggaaagttcaacatacagcacaattctggacacattgtattggtttgatgctcctacctggaacagatcctcatgagctagtaagtttgaaggggagtcataaagaggaacaggcattatacgcaaggctgaagaagcagttggtaactaacagtacatctttttctaaggccaacactaaacataagttgcagagctggcctgtggtggaactcacaagtcttattggcaatatatgtgaggagacaaaaagcaacatatggagaaatacaaaaatatactccctagagatactgcctcttcagatgtcaagaaaaacctggatgaaatgaagcaagagtggcacgctgcaaagttacaaattcaaggccacccacagaaccaaacattaacacttaggtggagctggtctcttgggcagcctgacatctggtccactcctctgtcctatgccgggatcatcatgaccgtagagattatgtcactgttttgcatccttgttacataactcagttcctggtagattccagtgaaaggcacatggtggtgatatttttgagaaagtagagaagaaaagaatgaatccggatggttgttgagacagaaactgagcgtcgaacctcattttctctcgtacccaaaccttgatgaaacaacagaggaaagtattgggctgcaattgtaggcgcacaaaagcaaaccttgagtcatggatgaccgaccaaggaagagtccccttgggaggaggaggtgccaaagaccagtgatactgctttgggttatgtgcactgagggtttccaaccctgacggatatggattctaatttaaaatatcacagggaagaaaaaaatagacgttcccatggcaacattttctcagggccagctcttctgtcttattatcatatcttatttaaatatttcctggaatcagtttaaacttaatccctctgtgtgtcttctattttcagtggccatggagagcgtaacatctggtcagaggttttccttaaataaatcatataattgtaggc

SEQ ID NO: 4102 - DNA, 719 bp, Homo sapiens
  ENST00000492335
catgtgacgcgcggccgcagctgcccgcgggcggagcgctctcagaccccggagcgcacaccgcggggccatcggtgccatcgcggatctccaggctcctcatcagtccgccggggccgcagcagcgcttctgggaagacgggcgatgaactgaagggcggctccgggcaggggggcacgatcttaaggacagtcgctccctgaacgcggagccggaggagacgaagggaaggtggagcggacgccacccgcgcaccgggcaggcgcggagaccggcgtgggacagccacctggagcgcagctgccagaaagaaggactttgctgctttgggccaggatctgaacttaggtgtaaaccattgccctggcagagggaacctacccagtccattgctgcctgctacaagatatgaacagtaatggcacatattttggttatgagtcactcagaggactgtggattgaatgaactgtatccatccccatcatgatgtacagaaccaagtctcttcactatgtacagtgtacttgaccagaggattcatgaggggcagtattgtagtacgcagagtgcggaagcagagaagagagtccagctgtttgttcgttaagccagatatggaagagatttgcaaaaaatgtaaatcatgtcacattttactaattttgtcttagaatatgtgttattttcattaaaagatactgtttaattatgctaa

SEQ ID NO: 4103 - DNA, 1101 bp, Homo sapiens
  ENST00000481779
acgtatttgcaatccccttatgccataattaaagaaggactttgctgctttgggccaggatctgaacttaggtgtaaaccattgccctggcagagggaacctacccagtccattgctgcctgctacaagatatgaacagtaatggcacatattttggttatgagtcactcagaggactgtggattgaatgaactgtatccatccccatcatgatgtacagaaccaagtctcttcactagtaggtatttttttaattaatatcatgtacacagttatatgttgagattttcaccagagtacctacttttataatgaaaaatgtgtaaaacacatgtattagtgtcgccggtatgaaatatggctagatctagtctatttctgtatcaaccaattgtaaaatgaagaggcatgctgagctgtatctattaggtataagtatataaatgtggtaattatgtatacctatataggcagaatttagaagtatagcatcttccctcttttttaactgaattaagaaacgtcactggacagtttcgatgtcttctggtcaatatcatatagatctggtgccaatgtaagcttaaactttttaccgagtttatgctttgcaacagtttaattttattatacagggtatttgatgtgcttccactcacagatgcaccatattaacagttggtgtatgatatttacggtgttgtggaaagaaaattaaactcagtcagaagatgttaatttcatttcagctccagcatttatcctcatactagtcccctaatctctaggcctcagtttcttcatttgaaaagtgaaaggaatcgtttctgctttacctagttcataagatttcctttgaaggtcaacagaggtaacggatgtgaaattattagctaactctcaaactctgtaaaaataaatggtgttgtctgtggtcaactaacagcacaagtagagagctggaaaaagttgtgaccataattgtctcttccaattaattaatgcagtctactattttatatgctacttgcctaagagataaatgataaaatcctcattaattttaatttatgacccaaattaatttttggtatatttgag

SEQ ID NO: 4104 - DNA, 8780 bp, Homo sapiens
  ENST00000255380
gggcaatggcgggcgcccctcccccagcctcgttgccgccttgcagtttgatctcagactgctgtgctagcaatcagcgagactccgtgggcgtaggaccctccgagccaggtgtgggatatagtctcgtggtgcgccgtttcttaagctggtctgaaaagcgcaatattcgggtgggagtgacccgattttccaggtgcttccgtcacccctttctttgactcggaaagggaactccctgaccccttgcgcttcccaggtgaggcaatgcctcgccctgcttcggctcgcgcacggtgcgcgcacacactggcctgcgcccactgtctagcactccctagtgagatgaacccggtacctcagatggaaatgcagaaatcacccgtcttctgcgtcgctcacgctgggagctgtagaccggagctgttcctattcggccatcttggctcctagtatttttaattaagcacttgtgttctgattagtggccaaataaatgacagtcagaacttcagctaaggtacaataaggttttgctgtggcgtggcacctggtctctttctagaaggaaagttcaacatacagcacaattctggacacattgtattggtttgatgctcctacctggaacaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgcacacatcaacccacagaccttaggaggaggaaggcgagggcggggtgacttctggtgatgataaaaatggttttatcacccagatgtgaaagaagctgcctgtttactgatccattgaataaacccattttaatagaaaaagtcaataccaattcagcaaaaagaaaaaaaaaacatactactgaatataaagaaatttattctgaaatagactttacgtgtttttttcttaaagaggagaaaaatattgcttgacggcaattatatacccaaagtgatttgcctgggtcctttaattcccattagctttggaatctcagatgagcatagctgacccagttcccacattcttcccaaggatcccaaaagtgggaatccagaccccaagtggaacactgcaggcttacgaatctgtggttccaaaattatttcatacgttgcaaagctgaatcttcttgtcccaatagagcttcctgtcttttctttggtgtgttgttaaactctatttgtggacttgattcttgattcttgcaaagtactgttttgtgcagttcaagtttcgtacaaataaaaatacttaagtatatatatatgtgtgagttctgcacgcacacacatagtgtatataatatcatgggaaacactgaactggcaaattattcctgcaacatacgctttcagtactttggtaactgaagttctctaggatcctaatgcaacattaacgtgaaataagcccagtgtaatgtttttgaaaccagggctgttttccacagagagcagccaggccttcccagcaggtctgtgcagagcggacaggctcgtgagtcagctgagcgccgtggcttcgccagacttggtgttaagcaacctcctttgttgatgtctcaacagagctaaatcggggcccctctgagctcaaagaatgaaccacatccacacgtttgaatttaatcatctaaatctgaatgtttcagaacaaaatttctgctatctaaactgcttgaaactcaataatagtgtcacgtttgaatgtcatacacagcaatatatatatatgtgtatatatatatatatggcaaagcaaaaaaaaaaacatggtaagagagaatgaaggagaacattgtgtttgattcttgctgaatggcaccttctcaaagaaaatagggcttgcacctttgttaatcagctgtggccagtgctttctggtgttcattgtgtaaccttcacccaggaataggtgaggttttaggaagttacatgtcctctgaagaaagaattacactctgaaaagtaatgcttcaaattgatttccttaccttttgggaaaaaaaaaaaattgtttttttgcattctcccttgaattgaccaaaatgttaactgtttcatttggggaggggatggggtgctgccatcattgtcgttgttgttgctgctgtagctgttggggtttcttttcctgttgccggggctgtttggggagagggaggggagggaggtgggagggccgcggagatatcttccctttgtacagggcattcgtgttgtgaacccagagctgggtagaagctgcttttgtattcagtgtgaggtggtgtttacagacgactttgacaacagtagaagtgtactcagtggtgtctgtgtatctgaactatttaatttcgtgttatgtttatatgcagaaatatttatggatactacaccaagtgtttatttaatgttgataaatatgactcttcagtcgtcagccatggtgtcctttcaaagtgattctttaaggtccacttgagcaatgaatagagtatattggagctttcctgtggctaagaagaagaaacatgtcatcctgttggcatcaccaagcacctaactctttctaggtaataaaaagtcaacggtcacttcaacgtaaatgtttaaaaccactctttagttaaatctgatgggaactgaacaaagctccaccattgtgtctgaaatcattttacacagggaaaaaaaaaaacaatcagcataattgtaagaatgatttttttgggcccacattcaaccaaagaacaagaaagaaacagacgattttctaatatgtacacagcaaactacagaatgtcatattatccacctgtgaaacatctagtaagcaattgcatctatattttatttctcaagttggcctggcactaataaatatgtgaaagcttattcaagtgtcccagtacttcagcacttcccatccttttggaaactcctatcttgcctccctcccaaaagggctgtttcttttattaaaaaaaaaaaagaaatagaattaaatttgagaaaaggagaaaccctgaaatttaacagaactttgagagtcacttccaatctccttaaacatgattatctccttatccttgtccttttgtgatgctaataatagcagaaaaggaacaaatccaagactctaggtctcccttttttgttttactggttttattatagaattgtttttaagcctcttatggatgaaagctgcatttaaatactatctactgattttatagaaaggtatgtccatttcttgggtcactttcagagaaagaaaacaagcaaaataggttcttttgaatatgaataatttaaaagcataattgaagatgtagtgagtatttataattggaccttagttacacgtgcatttctcaaagggcttgtcattacaggagatattcagcacttacctaagatcaaaatgtcttcatcccaaattgggaatcgaattatttcatgccatatgcatgaggtttgcagacatttcaagattagccactttgcttgaaagaagaaaatgatcaaacctaaaataaactacacatggagaatctctctctctctctctgcctctctctctctctttctccctcttcttccttctctctctctcacaagcacacacacacacactcaatctccattctccaggcattgccagatggttaggagaagtgagctctctctggtcccctagatccctcggctctgctctcctttgcccatcagctccctgtggcctctatgctagtcctccctattctcctagtcaccctttgcctcttaagcccagccttgactctctacatatttttcatttctctttaccctttagtgtacaatagttgtagactctgacggaatgaaaacaaacaagaagcctaagcgttagaccctgctgtggctaaagatctagaaggcatatcagttttctctgtcaggcttcctacgttgccctcgtgcagggctcattgctctgcagagcgctggaagccccttcatgtatcgagagagaagctggagcacagagctctgatgcacagttggctgtttcagctctgactcagggaggaaagaaggatgccaaggctctgtcacagcggagaagtctaataccagagtggcacagagaaggattccagggatcagtcagggtgtcctgtacctatctgagtagagatgattcaaggatggggacatattccaggaaattgcacaatcttcccctggcagcttcagaggacgagtgaaaatagtgcagtatagtcaaagaagcaatgaatttaggatgaggaacctgaagtttctggaccagtttggtcactgcttagttacatgtccttaggaatgcttgtcacttaacctaaactttctgggttttatcctcattgctcaaactaagcaacaacaccgaagcttctctaatttgccttctgatgccaaatcggtcaaaactgaggtcagcagctaccatgacgaaagtaaaatggtatattgggtgaatgtttgaaaatttcagattttatattctgtaaagttatttacttactctatttcaacaccacaaaatcttgaaatttggaaggtaaccaaggaagctttgaaatttgttggcaaacccggagtagtatggtttcaaataccactccaacccagcacctgaggtcgggcaaactcacaaaatagagtttctaggtagcaggtgtttgctttggttttgcaatagcatttctcataacagaactgaaactgtatagattacaacactccaaagttatttttttttaacctaaagaaccctacttctagcacctcctctgaaagaatattttgctccaataccacgtgcaacaaacttatttagacagtatcaactctagcccttaataggttcaaggacaagtttactgcttcctttctacacgcttaagttacactctcttctcctgttctgatgactctaaatcttcagcctctcccagcattaatgtgtgagtcaacattgcagacctgagaaaggtttctagaatggtaacccaatgttctttagaactggagaattccattttccttttctggctttagtgttaatgtctgggaagggaggctcatgataagaaaataaaaatgagaaaagaagatctagttcataaaatgactataccccacgtaagtttgtaactgcacagtgttttgttgtacggctcagaaatgagcaagtgttagtattattaggcacacatcacgttcacagcttcgcgcagagacggatagtgtatttggatatatggaagtcatccaaatgcgttgctagaatatcaggcctatgtttgttctggtagaaccacagagactcacacaaagttctgaccctaccactctggtctgggctgagaccaccccaaaaaatcatctagagaatcaaaggggctcacatctcagttgcattctatttaaaagataaaggggccatactctccactgcaaagaagcattagtaaaacttcccgcacccaaattataatccggcaaccctagcttcagctaaaaagattatccccagaatctaaaagcttactattgttctttcttggagtccaaaatgcttagcagttctgcagttcacatacaaaactcaaaactctttttatcctgtattctgtgagttccttgatgatagtaattgggtcttattcatcactctgtatcctgtggctcacacagaatctggcaaattgcatatattcaataaatgttgaatatctaataacctccttattaatataacaaatattatcaacattctgtgcacatcaatgtcccatgctgctactgtagtcaggagttatttggctgggaagtggaaagtgttcacaaacatgatgcttatctaataaaatatcactgagcaataaggagaaatattttaaatagatttgaagttgtgaacaaataatttagagtccaaagaggaaaaagaaaattaactctgttttttatccctagaactcagaaactttactggattggtcaacaaagacaaactttttattgtataaaacagtagaattcatggaagggataattcttttggaacaggcttctcggttacttgccttagtaaaagaagtatctggagggcctggagagttcataaacatagttttctgtgcaagtgaagatctgtagtttggcttaaaaatccttgcatgtagttttgcttggcgtggaaagttattaggagacaatcctttatcctgttctgcaagcaatcaaacacatgatctcccttctagccattcctcatccagtacatgggcatttccagcctcctacatgtaacacttcaaacttcctctgggcgtctgcttagagctatgtgatggccacagtttgggcaaagcccttctttcttttaaatataggaactgttaccaagtttggtgcaggcttgaggaataattacataaaaatgggcttccacgatggtgaatcagcatgctgatttctcttggcaggaagctctcagggaaatgtctgtgaatcatttaaagatgctctctggtggatagagaaaccgcagtccaaaaacagatgggtgtatatttgctttgtaagcaaagggcatgtatcatactcgcatctaaaacagtgtccacatctttgccaaaggcactgaattttacctttttttattacctcgtggccagcacttcctcagtaggcatttcaggtgtgtcacaaaccatgttcatttttaatcttgaaaaagtcaatcgtctgtagtctgtactataaaatgatgcctgcaactttgtggtgaatattatccccaagttaacagtgaaataagtaaataaaactattattgaacaaaga

SEQ ID NO: 4105 - DNA, 581 bp, Homo sapiens
  ENST00000487470
aaatgacagtcagaacttcagctaaggttttgctgtggcgtggcacctggtctctttctagaaggaaagttcaacatacagcacaattctggacacattgtattggtttgatgctcctacctggaacaggtaacagaggaagttcctaagttgtctggagattgcatgtcctcacacactaaaatcctctgagctgaatgattcagctttcactattgctgtgtctgtggacaaaaaagcaaaatgtgagtcaattccaggttccgtcacatttgggagttgccaagtaaaggaaaacataaaagattaatgttattattctgattttattttgttttgaggagaagcgtgggaaatgactaccatacaaatcaagaaattcatgaaggcaaacagttgatgactgtcacctagcaatctgttattttcttttatcctttccccaagacatatgccctctgacataagcattaaaatcaaattatacaattgtcagaaaacctgttctcaaagctttagggtaaaaattgtttaatcaaattgtaacacaaattgagaaatatcattaaagtgataatgcc

SEQ ID NO: 4106 - DNA, 587 bp, Homo sapiens
  ENST00000448020
ttttagtacggtattgttgcagctgacctgtatacgtaaggaattactgggtcatcagctctggggaatgtcttttgattatgaacacattttcagcatgtgtccactgaaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcct

SEQ ID NO: 4107 - DNA, 2294 bp, Homo sapiens
  ENST00000615928
ttgtttgttcttttctagcacttgtgttctgattagtggccaaataaatgacagtcagaacttcagctaaggtacaataaggttttgctgtggcgtggcacctggtctctttctagaaggaaagttcaacatacagcacaattctggacacattgtattggtttgatgctcctacctggaacaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgcacacatcaacccacagaccttaggaggaggaaggcgagggcggggtgacttctggtgatgataaaaatggttttatcacccagatgtgaaagaagctgcctgtttactgatccattgaataaacccattttaatagaaaaagtcaataccaattcagc

SEQ ID NO: 4108 - DNA, 333 bp, Homo sapiens
  ENST00000559002
attcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 4109 - DNA, 1889 bp, Homo sapiens
  ENST00000559658
gaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagctggagtgcaatggcgtgatctcagctcaccgcaacctccgccacctgggttcaagcgattctcctgccgcagcctcccaggtagctgggattacaggaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 4110 - DNA, 2030 bp, Homo sapiens
  ENST00000348639
gtccttcccagggtgtgttagcgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagaggaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 4111 - DNA, 3202 bp, Homo sapiens
  ENST00000326828
ccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagctttgtttttggcatttcgaggtttacttattttccacttatcttggaatcatgcaaaaaaaaaaatgtcaagagtatttattaccgataaatgaacatttaactagcctttttggtatggtaaagagatgtcaaaatgtgattctatgtgattagtatgctatgctatggaatatacatgtaaaaatgtttccttttagttgttgaaacaaaactggatagaaaaatgctgttcagaaatatgaaaagtcattcagttatcactacagatctcccagtaatttttcttatttagcccataatctctttgaaggtttatactaattcagcaatcccccatcgttacccatttcttaccatgcatttctcgttctttactgggtctaaagggctatgcctccatttcagagagcttcaactacttctcttgcatacttctaaattataccatgagaaatcatgcctagttattcattgttaatataactgtcttagtacaccataaactgggtggattataaacaacagaaacttctcagttttggaggttgggaggtccaaggtcaaggcaccagcaaatttggtgtctggtgagggtcctcttcctcaaagggtgccttctagctgtgtcctcacatgactgaagggactagctatctctgtggggtctattttataagggcactaaccccattcatgagagcagagcccccatggcctaatcacctttccaaggccccaccttctatctaagacaatcacgctgggaataggtttcaacatatgaattgggggaggacacatttggaccacagcatgaacctttagaacagggtttctcagccttagcactatggacattttgggctggataaatatgtgttggtacagaatgggggtatcctgtgcattgtaggatctttagcagtaccctagcctcaactcactagatgccaatgacataccttgcttcttcaccagttatgataaccaagaatgtctccattgttaaatgttcccttaggagcaaaattgcccctggttgagaaacattgctttagacaaattgttaagagtatcatgtactacacttctgaaacttaacgtgatcatcaccactgacagatgattcacagagactgtttgaatcttgtctcactagtttttcctgtgcaaaaataaaatggacagaattgcagccc

SEQ ID NO: 4112 - DNA, 573 bp, Homo sapiens
  ENST00000558903
aatctcctgacttagccaggatggtctcaatctcctgactttgtgatccaccctcctcggcctcccaaagtgctgggattacagtgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggt

SEQ ID NO: 4113 - DNA, 499 bp, Homo sapiens
  ENST00000561128
ctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaagtaagtgaccagaccctaggcactgctgccccctggtggtgactgttttatttgctttaggtgaaccaagaaaggcctaaagaccaggcttcatttacttctgtggaacccagattggggtccactgactggcagatatatctcttctaaggcttgaggtcacatgcactgccctacagtccccctggaaggactgtagggcccaacccctcaagtcccagatggacaggttgcagc

SEQ ID NO: 4114 - DNA, 535 bp, Homo sapiens
  ENST00000559080
gtttataatccttattttgactggtaaagacacaggttcagagaggttaagccacttgcctaagctcacacagcttacaagtgatttgtcaggatttgcaccagatctgtccaactccagagcccaggcttgcaaccactgtgcttctcactgaatgcgtgtggccaggtagaatcctgcccctcttgggcctcagtttcccattttgtaacccactgggttagactggcctgaaagtctagggttccacagaatccccccacaggtggaggggatgctgtagatgggtgatgtttctgctgggctgggtgggggaggttaagtaacgatttccccagggactgacagggctgcttcccacagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacct

SEQ ID NO: 4115 - DNA, 592 bp, Homo sapiens
  ENST00000559941
aagaggggagtcgcttcgggactggggctggagctggagcgccagcctctcctccggttgtagcctcctagcgctcctggctgcgtcgctgagggaccctccaccgggagagcgcctcctgtcttcctcccgctctccagaggagcctgctgggggaagccggccctggcccgccgctgggaggctcttgggtgcctgggagggctggtgggtagcgagagtcggggaccgggcaaggctgcagggaattcctggagggcccaggccggcggtctgtcgtgcggctgtgagctcagagcgctttccgccctcggtgccgaggcctgcactactcagaacgccatacgctctcaaccgacctcctgcctgggacccttctttcatcctggggaaggagagtggggagcaggaaaaatcctatttcaagacctgaggaagttggattcaacttcctagaggattctcctcccgcttccccaagctgcccccagatctgtacgtgggaatcagaagacagctgacccgtggccagggcctcagaggctgagcaccgtctatttgagcggctgtttgaagattacaatgagatcat

SEQ ID NO: 4116 - DNA, 2718 bp, Homo sapiens
  ENST00000308064
gctcggagctgtagccgccgctgccgccgctgctcttggctcggggacgcgggcgggcgctccgagaggctctggtgcctgcggctgctgctctcctccggcgcccggggctgcggcgctccgggtcccggcccctgtcccggcatctctcgggtccctgagccccggccccgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcggctgctgccgccgccgccacccgcgggtccccggcgaccctgactccagacccgaggatggagccggcgctgggcgctgcagctgctcccggcgcgtccccgaccaggtagctggtgtcacttcggtgtggttggaagaagactttctccccagctgcattcccggaggcgccctttcgacctggaggccgggtctgctggccacagggctgccgcactggctgggactgccagctgggcctggagacgctggtggctgtggactccccagcttggagcagtccctctttgacctcaccccttggagaagcagccccatgaaggtgcccagccatgcaatgttcctggaaggccgtcctcctccttgccctggcctccattgccatccagtacacggccatccgcaccttcaccgccaagtcctttcacacctgccccgggctggcagaggccgggctggccgagcgactgtgcgaggagagccccaccttcgcctacaacctctcccgcaagacccacatcctcatcctggccaccacgcgcagtggctcctccttcgtgggccagctcttcaaccagcacctggacgtcttctacctgtttgagcccctctaccacgtccagaacacgctcatcccccgcttcacccagggcaagagcccggccgaccggcgggtcatgctaggcgccagccgcgacctcctgcggagcctctacgactgcgacctctacttcctggagaactacatcaagccgccgccggtcaaccacaccaccgacaggatcttccgccgcggggccagccgggtcctctgctcccggcctgtgtgcgaccctccggggccagccgacctggtcctggaggagggggactgtgtgcgcaagtgcgggctactcaacctgaccgtggcggccgaggcgtgccgcgagcgcagccacgtggccatcaagacggtgcgcgtgcccgaggtgaacgacctgcgcgccctggtggaagacccgcgattaaacctcaaggtcatccagctggtccgagacccccgcggcattctggcttcgcgcagcgagaccttccgcgacacgtaccggctctggcggctctggtacggcaccgggaggaaaccctacaacctggacgtgacgcagctgaccacggtgtgcgaggacttctccaactccgtgtccaccggcctcatgcggcccccgtggctcaagggcaagtacatgttggtgcgctacgaggacctggctcggaaccctatgaagaagaccgaggagatctacgggttcctgggcatcccgctggacagccacgtggcccgctggatccagaacaacacgcggggcgaccccaccctgggcaagcacaaatacggcaccgtgcgaaactcggcggccacggccgagaagtggcgcttccgcctctcctacgacatcgtggcctttgcccagaacgcctgccagcaggtgctggcccagctgggctacaagatcgccgcctcggaggaggagctgaagaacccctcggtcagcctggtggaggagcgggacttccgccccttctcgtgacccgggcggtgcgggtgggggcgggaggcgcaaggtgtcggttttgataaaatggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccccccccattcagacacatggatgttgggtctctgtgcggacggtgacaatgtttacaagcaccacatttacacatccacacacgcacacgggcactcgcgaggcgacttctcaagcttttgaatgggtgagtggtcgggtatctagtttttgcactgtcttactattcaaggtaagaggatacaaacaagaggaccacttgtctctaatttatgaatggtgtccatcctttccccatccctgcctcctgcccctgacgcccatttccccccttagagcagcgaaactgccccctcctgcccgcccttgcctgtcggtgaggcaggtttttactgtgaggtgaacgtggacctgtttctgtttccagtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatc

SEQ ID NO: 4117 - DNA, 516 bp, Homo sapiens
  ENST00000533673
ggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccccccccattcagacacatggatgttgggtctctgtgcggacggtgacaatgtttacaagcaccacatttacacatccacacacgcacacgggcactcgcgaggcgacttctcaagcttttgaatggtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataa

SEQ ID NO: 4118 - DNA, 1361 bp, Homo sapiens
  ENST00000531322
gctgctcttggctcggggacgcgggcgggcgctccgagaggctctggtgcctgcggctgctgctctcctccggcgcccggggctgcggcgctccgggtcccggcccctgtcccggcatctctcgggtccctgagccccggccccgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcggctgctgccgccgccgccacccgcgggtccccggcgaccctgactccagacccgaggatggagccggcgctgggcgctgcagctgctcccggcgcgtccccgaccaggtagctggtgtcacttcggtgtggttggaagaagactttctccccagctgcattcccggaggcgccctttcgacctggaggccgggtctgctggccacagggctgccgcactggctgggactgccagctgggcctggagacgctggtggctgtggactccccagcttggagcagtccctctttggtaagtggttgaaccctcctgtgttctccccaggagcagccccagcccccactcaggtctggtagctgagccagcctccagagagggtgcctacaggatgctcaggtgggctcctggccccggactctcagcggccccattcgctctttctgcttctccatggtccctccccagtcccccttctgtgggcagaggggacacaggaggtaagaggggaggcccctgactccctaagatcttctttgcaggccagttcactctgtgtcagtggggattatgtcacctccatggcctggacccttgtccctagagaccaggaacagaccctgggtgctgggaagggttgcctctcagcagaccctggacatctgtctctgctccagagactcttagagactccacaagccccagaagtctacatctggagtaagtggtcacctgcatccatgagttggaaggggcttgacacagttgtccaccttgcctggccgtgctggcagctcaccgaccatggtctgcaggggtccttcatgctcaggggattggggtcagatggaggcatctgatagggactcttctttcccctagggatgggcagaggacagaggaaagaggaccacctggagaactgggcgccagctcgtgggggtgggagacgctggcagtgaggaggggcagtgtttgaggcaggccctcgtcatttcctcagtgtgggagtagggggagtcaggctcttgccccgtgaggcccctctaaggaa

SEQ ID NO: 4119 - DNA, 2842 bp, Homo sapiens
  ENST00000264249
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctgggatgagtgccagcctgagcctgcatggtgccgccgagcccggggtggaggagggagccaggcttcgcttcaaggcggcctctaccttttctcagaatggtttcctgattgtgtcaatgtgaaagttaaataaaatttatgtgccaaacctga

SEQ ID NO: 4120 - DNA, 1338 bp, Homo sapiens
  ENST00000409701
aagaaggagcatgtgcagcttcggtgcgaggggagtcaggggtgggaatgcacgttccctgcctgaggggccccggggtgccctgagcctctgatcttcgctgtcaggaggcctgtccgaagttggaggttgaggcatgcagttctgcacttctggctgggaagtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaa

SEQ ID NO: 4121 - DNA, 519 bp, Homo sapiens
  ENST00000484382
gcccggcgaagcccgacccgcgcggcgcccccagggccaggggaggagcctaaggacccggacgagcgccgctccagtaggtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatg

SEQ ID NO: 4122 - DNA, 604 bp, Homo sapiens
  ENST00000409046
tgggcccctctccccgccgcggggcgcacggaaaaaccggggaacccgcgggttttgtcctggcgagccacatcccgtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaa

SEQ ID NO: 4123 - DNA, 574 bp, Homo sapiens
  ENST00000420858
actatctaggtttatgtaagaacgctctgatgtttgcagaagaacatcgcctaacgatacatttctcagaagtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccag

SEQ ID NO: 4124 - DNA, 585 bp, Homo sapiens
  ENST00000448989
atgcaataagaaggcgtccttgtgcgggatgctgtgacccgcggaattattgatattgtgcgagcctacaatttacttctttcatccttggctgagaatttgcgtttgtaattgtagatggagagaggaagaaagggttcagcttgggtccaaggagcatgcagaggaaggcagggaagaaggagcatgtgcagcttcgtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatg

SEQ ID NO: 4125 - DNA, 559 bp, Homo sapiens
  ENST00000421474
agcgcctgggcccctctccccgccgcggggcgcacggaaaaaccggggaacccgcgggttttgtcctggcgagccacatcccgtgacaagaggaaccaagaacctcagttcaggggaaacacagcaaggaaatgtgagccccaggctgcagaagaccctactgtcgcattaatttctggcaaccacactgagaaaggtgtagattaagctggaaaatcacgaagagtgccaagggattggtcagtttttactgggggtctgcaccaggccaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctg

SEQ ID NO: 4126 - DNA, 692 bp, Homo sapiens
  ENST00000418201
gggtgggtttcagcgcctgggcccctctccccgccgcggggcgcacggaaaaaccggggaacccgcgggttttgtcctggcgagccacatcccgtgactgggttaaaatgaaaagacacaaagagagaagtggtcttttcccttccctccccattataattaagagcttagtccatcttggctcagaattggaattcagaattcagaattgctcttgaccctgaagaatagaatctcaaagaaatacctgagcagaaaattctcttcttcgctgaaatgaaaattggagtgtttgcaaaactgaacaaagaaaggaaagaatttgtaaacatcacaggcaacttgcagttatattcggatcatttttcagtgtttgaggagttcatacaataaaaagtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaag

SEQ ID NO: 4127 - DNA, 673 bp, Homo sapiens
  ENST00000435960
agtagggtgagctcggggacgcgcaggcgggtgggtttcagcgcctgggcccctctccccgccgcggggcgcacggaaaaaccggggaacccgcgggttttgtcctggcgagccacatcccgatggagagaggaagaaagggttcagcttgggtccaaggagcatgcagaggaaggcagggaagaaggagcatgtgcagcttcggtgcgaggggagtcaggggtgggaatgcacgttccctgcctgaggggccccggggtgccctgagcctctgatcttcgctgtcaggaggcctgtccgaagttggaggttgaggcatgcagttctgcacttctggctgggaaggtgaaccaggttttccaaaatgtcatttttgctttccaagtctgcaaggcaggaaagggttgggcagtgaatggaaagtagtgcagccaggttctggttagctcagcggcaggactgtcataacgtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatg

SEQ ID NO: 4128 - DNA, 564 bp, Homo sapiens
  ENST00000485085
gttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaccaagaacctcagttcaggggaaacacagcaaggaaatgtgagccccaggctgcagaagaccctactgtcgcattaatttctggcaaccacactgagaaaggtgtagattaagctggaaaatcacgaagagtgccaagggattggtcagtttttactgggggtctgcaccaggccaggcaaccctattggtgaccccaggaaacacacgaagccttatacacgggcacctgagggtggtttgcgagccatccggagaaaacccaggcagcttggcagatgcctggttcctgtgagattctaggatgtaaat

SEQ ID NO: 4129 - DNA, 596 bp, Homo sapiens
  ENST00000487860
aggagcctaaggacccggacgagcgccgctccagtaggtgacaagaggaaccaagaacctcagttcaggggaaacacagcaaggaaatgtgagccccaggctgcagaagaccctactgtcgcattaatttctggcaaccacactgagaaaggtgtagattaagctggaaaatcacgaagagtgccaagggattggtcagtttttactgggggtctgcaccaggccaggtgggtgctggttttttgtctacattgtctcatttaatcctcatggccactctgaggtagtggtaggaggagggccttctattagagatgggacattgaggcttagagaggttaagtgacttatggagtcacagagctaatgggtgtgagcagggatttgaaccaagtctggggttctttgtgcctcactatctctgacatggagtggcggaaggaggaggggattgtgggatggagacaggagacaggacagctggcttgcaaggaatttggcatgcccctgctgggtggtgttgctgataaactacagtacactcggttaaatgtgaagttcagaaaacaacacataggtttttgtttttgtttttt

SEQ ID NO: 4130 - DNA, 487 bp, Homo sapiens
  ENST00000466583
gtgttttggcgacttgaagacctccctagttcgcgggagtagcgggaagagccttcctcgcgttaattatgcaataagaaggcgtccttgtgcgggatgctgtgacccgcggaattattgatatttgactgggttaaaatgaaaagacacaaagagagaagtggtcttttcccttccctccccattataattaagagcttagtccatcttggctcagaattggaattcagaattcagaattgctcttgaccctgaagaatagaatctcaaagaaatacctgagcagaaaattctcttcttcgctgaaatgaaaattggagtgtttgcaaaactgaacaaagaaaggaaagaatttgtaaacatcacaggcaacttgcagttatattcggatcatttttcagtgtttgaggagttcatacaataaaaagtgacaagaggaaccaagaacctcagttcaggggaaacacagcaaggaaatgtgagcccc

SEQ ID NO: 4131 - DNA, 423 bp, Homo sapiens
  ENST00000550711
gtgcatgtccaggctttggggcaggtaactgaagtctttggcctatgaggtgagaggtcacttgggtgacctgggagtaaatcccttcccctccctggctctgtaaagccaagtgttaaatgagagacttatattccaggcaaaggctttgtgcaaatgcccatctaagccatgccctctgcaaggaatcccctttcttagtgatgatggtggggaggtggggagggtgcagtgcaactcccattcctgatctcctatcaccagagcagaagaatcactggagaacgactctgtctgaagcttgttcagcctggcttccttgagcaagcaacttattcacaggcgccctcccctcgccgggggccgcgagttgcatttggtaaaacccagccccggaatatatagatcgttggagcgcaatga

SEQ ID NO: 4132 - DNA, 936 bp, Homo sapiens
  ENST00000547956
ggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccagtcatgcggaggaatccctttggtgtggacatctgctgccggaaggggtcccgaagccccctgcaggaactctacaacccaatccaggtaagcttcaagcactctgtcagcatgtgaattttttttttttgtaggtatggatactaaaaactctaaaattgtggtctttgggggatttaaaacttcctttcacagcctggcattttaccttcagtggttgctttctccgtcaccctttttctatgtagcatctctgaaaaatctagcaggggatgtttagaattagagaaatgcctaggtttagtgctaagcattcagacctgcccagggtttgaactcctgagattaacagtctcaagttcgagcaatgggact

SEQ ID NO: 4133 - DNA, 5696 bp, Homo sapiens
  ENST00000549260
atatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaatcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatggtctcattatttctttttgtggcagcaaaattctaacatctttccagaagaaatctatgattcctgctttgcttgctacagctcatttgggggcatgaatgttctccttactaacctctcatggagtcatgtgataacagccattgtcatgtgtatggatgccaccattcttgaatttctgctagaaataagtaggttgctattgcacttagagtcatctttgcaagggactcattccaaaccaattccaatcgacctgaaagtcccttgcactaaagaaatgtgatttttttttaacccaaggagaaagttggttgtaacaatttttcaccagaattagcaatctgatagaataggcttttttaacaggaattttaaactggcggtgccagttgcagtgaaggtgaagtggctattgctttatattcgacaaatatttattgagcatctactatatactaggccctgaagatagagcgttgaacaaacccaatagtcttggccctcaaaaagctttatgtgacatagagcatccagctcgacaattagcaaacccctgatattattcatggacttgacatgaggtttggactattcatgagcaacagcagaaggtccatgacccctacaaatttacatttttctatggcccatatttgaaaacctcacattcggagcaggccactttatattcgtgagtgatcccaagctcactgaccaacagaaaagatgctaaaaaaatgtgtcctatcatgtgcctgctccaactgatgggtaatgtctgcctttaagccccagaatggattctccaggcacagtgtggaagagtgctgtggttgattagcaatgtctgccttgggtgaggaaaggggaacactcctcaagtgcctcctactgtcatctccattcagcctagcaccacatccccatgtagaagtgttgtcttctactgcttgccacgtacaagtgtgaaatgccaaggtgagactcgtacacttggggatttgcaatggtttttacccctcatgaaggtcagaggtggactatttgtacacatacacacatgcacaccctctcacgtcctccagaggctgaaagactatcagcatcttggtaactgccatgcatgagcagcaaggacagccttccataatccatgccccatttcctctggaagcctggaaacttttcatttcctgttccttgctaattaacatctaaacatgcttctcatttccagccattgctgatgcttctcagttgaagtttgagccacatccctcttacagctagtgaatgagttggtagcagctactgtatataataataataatagttttaataataggggagggtgggatggggtgtgggtaagttttgccttttgttttgtttttgatgccgtatatagtgaaggggtgaggatattctaaacaaacaaaaattgaataatttattcacagaaactattaagattgtattgtaaagctcacagcaagctcagtgggcagcagctgcaacatctcaccggggaaattattttatttaacgtgagtgagatgtgggccggagaaggtagctgaagctatttataaaacgttgtgtaccttcttccgagctctctcccctttgtgaagggcgcagcaactatacccttgatggatggagatttacgcaatgtgttttactgggtagagtgacagaccttggctgtccctggaattgagaatctggaccttatttccaggcagagaacactgtcctcagaaatgggacttctgataatgaaacaggttgtccaacattttctaatacgcattctacagaacacaggttccaggaggcatcaggttggtgtgatgcagactaagggttttgtggtcaaatatccttaagaaacaaagttaagtcagtttcctttctgcaaggacttttcagccttcaatgtgtgctgtgcatggtgaatccccaaaaataatccttgagtctgtagcatttcctgaacttacatgaccaggatactctattttgcagatcaccccacagagctagggttccaccgagtatactttgcttaggttgacttagcatatctgaggtcttcaaggataaaaactgccaccccaacacccttccattaaaaaaaaaatacaaaatagcaccacagtctccatctggtttatagcaacagaggtactttatttaatgaagcaatggttctaatcctggatactgccacggactacaattctatccctcccagagggagtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgcctggaaaatgaaagtttgtgttttttaaagaggaatatttgaaactgctttctatgcatgcttagctggagaaaagtacaggcaggcgtcccatctcccagccacttctcaaaggtgctgctgtgttttaaagaccaggtacagccagggcagtatttgcaaggacattcctgcttactttatccctttggttggaaagctctagatgattcccgcagctcctccagaccccgcctccctgccctccccagctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacacacacaatctcagctgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttcttttttcacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaagaa

SEQ ID NO: 4134 - DNA, 5709 bp, Homo sapiens
  ENST00000303694
atatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccagtcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatggtctcattatttctttttgtggcagcaaaattctaacatctttccagaagaaatctatgattcctgctttgcttgctacagctcatttgggggcatgaatgttctccttactaacctctcatggagtcatgtgataacagccattgtcatgtgtatggatgccaccattcttgaatttctgctagaaataagtaggttgctattgcacttagagtcatctttgcaagggactcattccaaaccaattccaatcgacctgaaagtcccttgcactaaagaaatgtgatttttttttaacccaaggagaaagttggttgtaacaatttttcaccagaattagcaatctgatagaataggcttttttaacaggaattttaaactggcggtgccagttgcagtgaaggtgaagtggctattgctttatattcgacaaatatttattgagcatctactatatactaggccctgaagatagagcgttgaacaaacccaatagtcttggccctcaaaaagctttatgtgacatagagcatccagctcgacaattagcaaacccctgatattattcatggacttgacatgaggtttggactattcatgagcaacagcagaaggtccatgacccctacaaatttacatttttctatggcccatatttgaaaacctcacattcggagcaggccactttatattcgtgagtgatcccaagctcactgaccaacagaaaagatgctaaaaaaatgtgtcctatcatgtgcctgctccaactgatgggtaatgtctgcctttaagccccagaatggattctccaggcacagtgtggaagagtgctgtggttgattagcaatgtctgccttgggtgaggaaaggggaacactcctcaagtgcctcctactgtcatctccattcagcctagcaccacatccccatgtagaagtgttgtcttctactgcttgccacgtacaagtgtgaaatgccaaggtgagactcgtacacttggggatttgcaatggtttttacccctcatgaaggtcagaggtggactatttgtacacatacacacatgcacaccctctcacgtcctccagaggctgaaagactatcagcatcttggtaactgccatgcatgagcagcaaggacagccttccataatccatgccccatttcctctggaagcctggaaacttttcatttcctgttccttgctaattaacatctaaacatgcttctcatttccagccattgctgatgcttctcagttgaagtttgagccacatccctcttacagctagtgaatgagttggtagcagctactgtatataataataataatagttttaataataggggagggtgggatggggtgtgggtaagttttgccttttgttttgtttttgatgccgtatatagtgaaggggtgaggatattctaaacaaacaaaaattgaataatttattcacagaaactattaagattgtattgtaaagctcacagcaagctcagtgggcagcagctgcaacatctcaccggggaaattattttatttaacgtgagtgagatgtgggccggagaaggtagctgaagctatttataaaacgttgtgtaccttcttccgagctctctcccctttgtgaagggcgcagcaactatacccttgatggatggagatttacgcaatgtgttttactgggtagagtgacagaccttggctgtccctggaattgagaatctggaccttatttccaggcagagaacactgtcctcagaaatgggacttctgataatgaaacaggttgtccaacattttctaatacgcattctacagaacacaggttccaggaggcatcaggttggtgtgatgcagactaagggttttgtggtcaaatatccttaagaaacaaagttaagtcagtttcctttctgcaaggacttttcagccttcaatgtgtgctgtgcatggtgaatccccaaaaataatccttgagtctgtagcatttcctgaacttacatgaccaggatactctattttgcagatcaccccacagagctagggttccaccgagtatactttgcttaggttgacttagcatatctgaggtcttcaaggataaaaactgccaccccaacacccttccattaaaaaaaaaatacaaaatagcaccacagtctccatctggtttatagcaacagaggtactttatttaatgaagcaatggttctaatcctggatactgccacggactacaattctatccctcccagagggagtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgcctggaaaatgaaagtttgtgttttttaaagaggaatatttgaaactgctttctatgcatgcttagctggagaaaagtacaggcaggcgtcccatctcccagccacttctcaaaggtgctgctgtgttttaaagaccaggtacagccagggcagtatttgcaaggacattcctgcttactttatccctttggttggaaagctctagatgattcccgcagctcctccagaccccgcctccctgccctccccagctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacacacacaatctcagctgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttcttttttcacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaagaa

SEQ ID NO: 4135 - DNA, 756 bp, Homo sapiens
  ENST00000546689
gcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaatcatgcggaggaatccctttggtgtggacatctgctgccggaaggggtcccgaagccccctgcaggaactctacaacccaatccaggtaagcttcaagcactctgtcagcatgtgaattttttttttttgtaggtatggatactaaaaactctaaaattgtggtctttgggggatttaaaacttcctttcacagcctggcattttaccttcagtggttgctttctccgtcaccctttttcta

SEQ ID NO: 4136 - DNA, 573 bp, Homo sapiens
  ENST00000549016
atagatacctgaacacccgtgttcatagcagcatgagtcacggtggccagaaggtggaagcaaccctaatgcccatcagtggatgaatgaatagtgtcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaaca

SEQ ID NO: 4137 - DNA, 15979 bp, Homo sapiens
  ENST00000258711
gggctgcctctggggggtccgctagtcgcggggcggcggcggcggctgcgggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctactaaaaaaaaaaaaaaaaaaaaaaaaaaaaaaaaaaaaatgagtcgggtgtggtggtgtgcacctgtagtcccagctactcaggagttctgagatggaaagattgcttgaacccaggaggcagaggctgcagtgagctgagatcgcgacattgcactctagcctgggtgacagagtgagattccatctcaaaataaataaataaatattaatacattatggctattaaggctgggcacggtggctcatgcctgcaatcctggcactttgggaggctgaggggggaagatcacttgagcccaggagttcaagaccagcttgggcaacatagcaaggacctcatctctacaaaaaataaaaaggacgtggtggtgcacatctgtaaacccagctactcaggaggctgaggagggaggatcacttgagcccaggagttcaagatcagtttggaccacatagcgagaccctgtgtctacaaaaaataagaaaatcagccggacatgatggtgcacacctgtaatcccagctactcgggaggctgaggcaggaggatcgctggagcccaggagttcaaggctgcagtgacctatgatcgtgccactgcactccagcctgggcagcaaagtgagactctgtttctaaatagacagatagaagataggtagatagatagattaaatagaaagtaaactatggctgttgaggtttacagttggcaggagtggagtggtttggcgtttatctctagaccgtgctggatgacagtacccagtgtcaccaagaagaggctccgtgtgactgtctctgtggctttctggttggtttagctccagtgccttcaccctcaaggacacgactgaccttgaaccctcaggtttgatgggccctgtcttgataaaagtgtcagaggaggctctggaaacatctggctgaaactcctttgctatttctgcttctaagctgtagttggagagatggttgcaatcatttcgtggtgtcgggcaccctgcttgacctgtcttcctcgtgtgtggtatttgtcaccactgcccagtccctggttgctggccacgctcagttgggacataccctggtgtcctctgtgtgtggtgtccctgtgtttcccaggctcaggtgggcttgtgtgggtcttggcccccagtgcctgctagcctcaggtgtcccctgtgttagacacctcctgccttcctttctgaagcttcgctttcttttatttttgttttgttttgtttttggagacagggtctcgctctgtcatccgggctggaatacactggtgcaatcacagctcactgcagcttcaacctcctgggctcaagtgatcttcccatctcagactcccaagtagctggggttacaggtgagcgccagcctgcccagctagttttttattttcagcagagatgaggtctcactgtgttgcccaggctgctctcaaactcctgggctcaagtgaccctcctgcatcaccctcccaaagtgctgggattacaggcatgagccatcacacctggcccctccaagttttttattatgataaaaatgtttaattttaaacgtaccatcttaaccattgttaagtgcactgttgtgtggcattaagcacattcgtattgtcgtgccaccaccaccatcatctccagagctttctcatcttcccaaactgaaactctgtccccattcagcactcgctccccattggtagaaggcagcagcttccactctctgatttctactacccgagctccctcagaaatggagtcacacagtattggtccttttgggactgaagtacttcacctcatgcaatgtcctctaggttcatcggtgtcgtggcaggtgtcagaactaacttcctttctgaggcggaataatgtcccattgtgtggaagaggcatggtttgtttatctgttcatcagttggtggacactgagttgcttctgccttcctgcgaatgtgaattgaatgctgctgtgaacagggtgtcagtgaatctgctgagggcttgttttccgtattctgggcatggccctttgtgtctgcctttgctggagcacctccccgggatgcgtttgtttataggatgttcagacgaatgtcagaacccactgggcggttcactcactgaggggggcccgcgtcccctccatttctgcattcccagttcttggtatggttcctctgaggttcggttttcctgagcacctggggtgtttgcagggatgtggaggggttcctgcagaagacaccacccacatccacgcacctgctcagattcccgggccatggtcggggccaccgcccgtggggatgactccggatgggagtggcagaaaagggcctgctgggccgaggggaggcgtctccgggaagagagggaggtgtgagcggggagaacccactttgattcttcgctgtttgcctgatgcgcagcaccacactgcgtagagacctttggctctggttttttctttttccactgaaacacagcaaattatacattttatgaaaattggcatcgtacaactggaaaatttaaccataaacttaaaactcttttaccctgttggcccccatcctccagctgtgtccacactttgagcacagtcatgagaatgacttggttgggtgcggggtggtgtcacaaagccctgtctcttgtgtgatggctgcgcctcgaatcagtgggagggcacctcgcccgtttacagttgggcaatgcttgggctgggcggcctggctgctcctggactcgcctcccagcgtctgatgctgtgtattttccatctgccccaggaatttgacacaggtgtgacttgcaggttgtgtgggtgatgcctccctccctctttcctcttaaagcatctcatgcttcttcattcgctgatacttacaacccccagtggatatttagtggagtttgctgtagtgcttttgccatttatttggactattggaaaaatttcaggtttggttttggccctatgtcttgatggagggcaagggttaggatttcagtttatcttcccggtgaggtctgagcacgtctgtgccctgaggtgggtggtttggtgaaggtggggctttaacctagctctgccacttaggaatcagaacacacacacacacgcgcgcacacacacacacacacacacactctctctcacacacacatcgggatatttttcttgtttccttcttccagagggtgtaggagttgtgttccaagtttgttcctgcaaaccctccgatgaggccagctgcattcatcggggcctggatggccgcacctctctctccccgccctgtctcctgcactcaggtgagaggctggcagggctgccgtaggggtggagagtgaacgcagggtggctaagccctcgtccctgtgagggacagtgacacggatgggagcagccatctgagctggaagctgtggacatggtccttgtgtgggtccaagcaaagtgggtggcgtgtgcattttgtgaacacgtggtctgcttcctggtgcagaccaggtctccccagagggaccctcctgagctgagctgcccggggcacctgtccctggatgtgaactgccttggttgtaccttggtggggggacctttcctgaatgtgttggttcggcatggtgacaggtgtttccctgcggcagaatgttggggccacaccaacgtccccagagtcttctccctagagtctctgaaaggaagcctgggttcctggtggtgctcccctccatgtgtgctcacccgcctgtatggaggcagcccaggggagcggctgagactcttggcagagagctggggacgctctgttctcattggcagccccaccctgaagaataacagactcccaaatatcacacaggctgcagataccacccagcccccaaggatgccatcaccaggctggggcgctcccatgcccattatccaggggtaatttttgctcacttatttataagccacacatcctcttctatcctaccaaacctaagaatatcaaaagggaaagcttggcttgcatggacgtaattaacctaaaagtctttaaacgtttctcccgagtgttggagtgactgtttgcacacatctgttgtgttttgcctgtgtgcattcctcctcctggtcagagagcccgtctcttccgccctctcccttaccctaggagggctgagtcaggcctccctacccaggcccaagggcagatgcacctgagccattgtgtcccatggttgatacgggacggggctgatttcctgacctggacccctgagacccagtgctcttagctgtgagcctctgggaagaggttctggcaggtggaggggatggacgttacagtgctgtggccacctagaaaagccgtcccggaactgagaccaactgctgagggaggaagggccaccagatcgggggccgggccggggtgagcacctgaagccggctccacctgctcttctcagctgtgcgcctccaggaatttgcactcgcttcagctgatttgggttggatttctagcgtttcacatacaggatctagactcgcacacaactgcattaatatgttggtgtttgataaactagggttgaaggagttccatcagtgaagagagaagccacgtgacctgaggatgcagggcactgttcacgtggacatgagccgtttcttagcatcatgagattttagaaacatgttcttactctgccaggacccagggataggtgaggctctcctattgggataccatttcaccagcagagagattaattggagaatgtgtaattttttcccctttggaaataatttgttcttttttttttttgacagagtttctttctgtcatccaggctggagtgcagtggtgtgatcatagctcactgcagcctcgacctcctgggctcaagtggtcctcccacctcagcctcccaagtagctgggactacaggcatgcaccaccatgcccggctaatttttacatttttggtagaggccgggtacggtggctcatgcctgtaatcccggcactttgggaggccgaggtgggtggatcacgaggtcaggagatcaagaccatcctggataacatggtgaaaccccgtctctactaaaatacaaaaaaattagccgggcgtggtggtgggcgcctgtagtcccagctactcgggaggctgaggcaggagaatggcgtgaacccgggaggcggagcttgcagtgagcggagattggcgccactacactccagcctgggcgacagagcgagactccgtctcaaaaaaaaatttttttttttggtagatacggggtcttgctttgtcacccaggctggtctcaaactcctgagctcgagtgctccttctgcctcagcctcccaaagtgctgggattacaggcgtgggctgctgtgcccagcaggaataatttctcagtgcatctctgatggggaggctaatgaagaaaggacacctggtttgaaggcttctctgtgtctgtccgtgggcgctactgatctgagccaagcaccattccgcaggcatgcctgaaatgactcccatggctgtcatggtgccatctggagagcatttgctcactgtaatggtcccgtcacacttgtctgatgaggatctgttggttgactttgacagtgataaacgaacacagcctatctgggtgttttttgcacttatagtttgggggtttgaagtactggctagaagctggcggggtgtgtgtgtgcaggtgtgcgagtgcatgtgcaagtgtgcgtgcaagtgtgagtctgcacttgtgtgcaagagaatgtgtgtgtgtgtgtgtttggagatttggacttgaaaattctagctcaggtctttggggtagtgtttgacctgaactctgaaaggcagagggtcccagactttcctgggatgatgggaactgggcaccccagatgaggctcggttgtgagtaggagcggggtgggccaccgaagagaagacagagtgggcctgtagggccagcccgaggtacccacagtggagggtctacaggctgatttgggaggtggtggtttatacctgtagtcaccttctatcttagttaggaattcaccttcacacttccagaaactgccaagaagaatgccgccgctcaggtttatctggtagaataagctgtttgaacaaagatctggaggttgcacaatcctgtgtcattctggatttatcttggggtcgggagtcaacgatacttcttgtgctgtcgtttctccggccgtgtgaagttaccacctcgtgagtggtcataagttagcgtgtctaaatgcactttgaaatcctaggatgaaaaagccaggccctgtcttttttccttgtctaagcaccatccttgcttaggagagacacggctgtggctctcaggctgtggggcaatgttctgcttataatgtttcaagaggttcaaagcgtgcaggccccatgctccgtgagagccttgacctgggtcagcaggggcggctgggcttgactcgagaattcccacagggcccgagggaagagcagagcaagagggaggagcgcgtggagccctatgtggcctgcgatattggggtggcgtccaggcccgcctagatgggggagggagacaacagagctgccacctgctcaccgcagacccaggggcccaggaggagcggactaggaccggcagtgccttccagcctaggtctcctgcccctgggctggagttcatcttttaggcaaatttggaataggaaccttaaaaatgctttcttcactcgtttaaatagtaatgataagaatatggctgcagggggcagcttatgcctgtaatcccaccattttgggagctcaaggcaggagtattgcttgagcccagaagtttgagaccagtctgggcaacatagtggaaacttgtctctccaaaagctaaaagaaaaagccgtgcatggtggtatgcacctgtagtcccagctacttgggaggctgaggtgggaggatcgcttgagtctgggaggtcgaggctgctgtgagccatgattgcaccactgcattccagcctgggtgacagagcaagatcttgtcttaaaaaaaaaaaaaaaaaaaaaggtgttgtattttatcattagaaggccatcctgtttagaagagtgggtttctcataagaaaaaaaagaaaaaggttgaccttgtaagtatattttcttgggtgaattgtggtggtggtaatggttttaactggtgttaatttcagttcttttaaaagttgtggtaagatacatgcaacataaaatgtgccctcttccccatttttaagtgaacagttcagtggcattaagcacattcagtttgcctgccaccgttaccaccatccatctccaaaattctctccatttacaaaactgaaactctgtccctattaaacactagctccccattccccactgtgccgcccccccaaagcccctggcaccaaccattctacttcctgtctctgagtttgactagggacctcctgtaagtggatttgtacaatatttgtccttttgtgtctggcttcttcatgtagtataatgtcttcaaggttcattcatgttgtagtcaggatcaccttccttttaaaggttgaacgatatcccgttgtatggacagaccacattttatccattcacccagggatggacacctgggttgcttccatctctcggctcttgtgaataatgctgctgtgaacacgggtgtgcagatacctgttcaagtccctgctgttttcttttgagacggagtctcgctctgtctcccaggctggagtgcggtggcaccatctcagctcactgcaagctccgcctcccaggttcaggccattctcctgcctcagcctcccgagtagctgggactacaggtgcccaccaccacgcctggctaattttttgtatttttagtagagacggagtttcaccatgttagccaggatgctctggatctcctgacctcgtgatccacccacctcggcctcccaaactgctgggattacaggcatgagacaccacgccccgccgagtccctgcttttaattctttggggcagggatccccaaccccctggtgatggaccaatactggcctgcggccccttaggaactggactgcacagcaggaggtgagcggcaggtgagcgtgcattcccgccggagccccgcctcccgtcagatcagcggcggcattagattctcataggagcgggaaccctcctgtgaaccctgcataccagggttctccatgcaacaatctaatgcctgatgatctgaagtggaacaggtttttgttttttttttccagacagagtcttgctctttcgcctaggctggagtgcagtggcatgatctcggctcactgcaacccctgcttcctgggttcaagtggttctcctgcctcagcctcccaagtagctgggattacaggtgcccgccaccatggccagctaatttttttgtttatttgtttatttattattttttgaggtggagtcttgctgtcacccaggctggagtgcagtggtgcaatctcagctcactgcaacctctgccttctgggttcaagccattcttgtgcctcagcttcccgagtaggtggaattataggcgtgtgccaccatgcccagctaatttttgtatttttagtagaggcgggatttcaccatgttggccaggctggtctcactcttgacctcaagtgatctgcccgcctcggcctcccaaagtgttgggattacaggtgtgagccaccgtgctcagcctgaagtgaaacagtttcatcccaaaagcatatacctctgccccatccatggaaaaattgcctctcatgaaaccagtccctggtgccaaaaaggttggggaccgcggctctggagtatatgcctaggagtaggagtgtggggtcatatggtaatttatctttaatttttggaggaattgaatttcaattcttattattaccaaaaatacttaaaattcttacagatggcatgggaaagtagcacacagtcgggactctgcagccgagtttgcctccttgaatgcacacataacacaggaacaaagacagagctgcttccctcctgttgggtctctggcggacagtcaggtatgctgagggagacactgttctcaaactccaggccagggtggtttccggagggtccaccggtggtctcatctcttctctctcaaaccatggatggtgccttttaaagaaaatgacaccggccaggtgcggtggctcatggctgtaatcccagcactttgggaggccgaggcgggtggatcacctgaggtcggaagttcaacaccagcctggccaacatggtgaaaccccgtctctattaaaaatacaaaaattaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatacaaaaattagctgggtgtggtggtgggcacctgtaatcccagctactgaggaggctgaggcatgagattcgcttgagcctgggaggcagaggttgcagtgagctgagatcgcgccattgcactccagcctgggcaacagagtgagactctgtctcaaaaaacaaacaaaaatcaaagtgccaacctctgggctgtcccctcctggcctgccttgttcctgagctcaccagggtccttcactctgtggcactggcctcagccagcaccaaggctgaaagagcccattcagaggccagaaagaaactgttaggctctgaagccgtgggccaggccaagacagagattctgaggcatggttctggaatgggtttttccgcccacaggcactcaaggaggacagcattgggagatggctgggtggagagtctgcgggaggctacaaggcaaaaatcccctactccccctgggctccttcacagtttgtgtgtcctcacagagcaaggaagttctgtgagcctcattcaatcatctgaggttcttcccaggaaaattatagtgggaactctggctttgatgaaactgcttttttttcaaagcagtttgcaaaataaccggggccttaaaaaacaatctggatgaaatggtttttgccatttcaattggttctcttccaacgtgtcttccttccagtaggtttccagaatattttggtttcaaaatttgggggcacagatttgcaaagtggatttcaacatgtcgggtttcaaagggggctggctttgaaagtggtctgggcttctaaaaggtttgattgaaaactggtttggttctcagacattccagaagcttctcccggagtccagagcctcccagtggtgctttgggaagggggccaggcagggcgtcctggtgagtggacgtagggtgggcagggccacccttgtcctgggatgttgtggaggacttggcacgccctgtctcaggcctggctctggctctgggtggatgttttgcatcttcagaaaaaagctcctgtgggatatttctcctccagccgaccccgccccccagggcattcgagaaaagggtgcttgtctcttggtgagagggccacggttccttcagtttctccgttcctacgggcctctttctttttcctttttgagacggaatctcactgtgtcgcccaggctcactgcaacctatgcctcccgggttcaagtggttctcatgcttcagcctcctgagtagctgggattacaggtgtgtgccaccacatccagctaattttttgtatttttagtagagatggggttttcccatgttggccaggccggtctcgaactcctgacctcgtgatctgcccacgttggcctccaaagtgctaggattataagtgtgagccaccacaccaggcccgtttcatccctgcctcagcctgcatgccaagctccctgggtgcccgcccacaggtgtcaccctttaaggagaaagtggcctggggctggaaacaggactttgtagggaaggacagcgcgtgtgagaaaaggcctgttgatgggcacgccagggtttaatggacggctctttgaagtcatgggctgagccagaaggaattgtcatgatgtcagtctcatttccagatggggaaagggagacccaggctgcggtgacccactgaggcacaggatcagtgagaacccagccctggctttgcccagacctctcaagggcacttcgtgggaccattgccggccgttgtggcatctgtccctggccttgcccccatccgtctctgcacagcccaggtgggtccgagccagccccaggtctccagggtcccagcccagcctctagaagagccagcagcagggctggaagggagagcacatgctgggccttggggctgccttggacctcaggccgttgacaaggaaaagcggagagttgggaaaaaaggacaaatagctgagcgccagccgcagtctgggggacgggagcctcgtgcgactctcggagtgctggccagattggcagaggggaggagagaggaaaaacccaggctctgaggaaaaacctctccagcccagcgcgtggcctggcattaacccactgcagccccaggaagtggttccaccccaggcagccaacaaggcggtgcctgaactatgtctgtggatgacggagccacgacctgtccctcagggctcagcgctgcggctatgtccagggacccctggctgtgcccacgtcggggcttcccgttccttacctgccatgagaatgagatgtccagggacctccctgctccagctgggacctgtggggctttgtctgttgtcccgagcaccttggagatgtcatttctaacattttaacccaggaatccccccaccaagggacagagtgcaaggacatgatcgaacagaaaaagttctggtacaagatcaaccccgtggggtggtgagtgctgcagccccgggcctcacatcctgccgtccctgtgggagattggagcggtcccagtgcccaccgctgattctctggctccagcaacccctccaggtggatccgtcccacgcagcctggcctgaaacactgcccagccactgggtccagtaagacagagcctcgagtcattctgccaagaggatccagaaacacagactttttctggggtcctggaggcttctggcccatggggagcccctgggtcccagcgatccagccctgatgtgctgagggtgcagggcccagctgcagagcagaggagagtggcccccagggaccagcagcacgaaaggcacactgaggcacactggcaggcctgggctgcagagagcctgaaggtcatggggtagctggtggaagcaggaagaccccatacagcagcgaccactgaggctggtgctgcactttctcagggaattgagtgtgggctcccaccatcccggccactggcttcctccaaagcctcctcctcttacatcagcaaaccttctgttcggtgaccccctcagtgaccctctgtgcttgccttcgtggtcttcctcatggaggatttcgggtcagcgtgggggtcagaggtcatttcccataccccctcaaaggtacttcttgctgtggtccccacactctgacaccctcttctgaaatgaacacttttttgttgttgttgttgagacagagtcttgctctgtcgcccaggctggagtgcagtggcacaatcttagctcactgcaacctccacctcccaggttcaagcgattttcatgcctcagcttcccgagtagctgggattacaggcatgtgccaccaagcccagctaatttttgtatttttagtagagatgaggtttcaccatgttggccaggctggtctcgaacttctgacctcaagtgattcgcccgcctcggcctcccaaagtgctgggattacaagcatgagccactgcgcccggccacaaacacttttttttttttaaacaagtgaaaacaagtttattaacaaagttaagaaataaagaatggctattccatagggagagcagcctgaataaacactttttttgttgttgttgaggcagagcctcactctgtcgcccaggcaggagtgcagtggtgcgacctcagctctcagctccctgcaccgtccacctcctgggttcaagcgcttcttccccaagtagctgggactataggcacacaccaccatgcccggctaatttttctctttttagtagagacaggatttcgccatgtgggtcgggctggtctcgaactcctggtctcaagtgatccgccctcctcggccttccaaaatgctaggattacaggcatgagccgccgtgcctggccacaaacatattttaaatttgaacaataaaggaactggaccaggaagtgtggagttggggagaccctgctctcgccaggtgccttcccggcaggttgtctctgcctccccttgcaccccttgaatggcgggctccctctcccatagcccctgccaggctggataaccaacttcattcttatacccgtccgaatctgccccctgttaatggcacccaccagtccttgtccaaacctcgaagctcaggacctcacagagcaccacgtcctcttctgtgtcatatgcagctggatctcagtaaatggcaatgtcttctct

SEQ ID NO: 4138 - DNA, 921 bp, Homo sapiens
  ENST00000432336
ggatccccagctcccgagggcccccgtgtgcctgctgtcacctgaacggggctccccggccccgccgaccgcagccctggagcctgcagacgccagcagcaccggcaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcg

SEQ ID NO: 4139 - DNA, 2067 bp, Homo sapiens
  ENST00000313156
cacacacacatcgggatatttttcttgtttccttcttccagagggtgtaggagttgtgttccaagtttgttcctgcaaaccctccgatgaggccagctgcattcatcggggcctggatggccgcacctctctctccccgccctgtctcctgcactcagtctcatttccagatggggaaagggagacccaggctgcggtgacccactgaggcacaggatcagtgagaacccagccctggctttgcccagacctctcaagggcacttcgtgggaccattgccggccgttgtggcatctgtccctggccttgcccccatccgtctctgcacagcccaggtgggtccgagccagccccaggtctccagggtcccagcccagcctctagaagagccagcagcagggctggaagggagagcacatgctgggccttggggctgccttggacctcaggccgttgacaaggaaaagcggagagttgggaaaaaaggacaaatagctgagcgccagccgcagtctgggggacgggagcctcgtgcgactctcggagtgctggccagattggcagaggggaggagagaggaaaaacccaggctctgaggaaaaacctctccagcccagcgcgtggcctggcattaacccactgcagccccaggaagtggttccaccccaggcagccaacaaggcggtgcctgaactatgtctgtggatgacggagccacgacctgtccctcagggctcagcgctgcggctatgtccagggacccctggctgtgcccacgtcggggcttcccgttccttacctgccatgagaatgagatgtccagggacctccctgctccagctgggacctgtggggctttgtctgttgtcccgagcaccttggagatgtcatttctaacattttaacccaggaatccccccaccaagggacagagtgcaaggacatgatcgaacagaaaaagttctggtacaagatcaaccccgtggggtggtgagtgctgcagccccgggcctcacatcctgccgtccctgtgggagattggagcggtcccagtgcccaccgctgattctctggctccagcaacccctccaggtggatccgtcccacgcagcctggcctgaaacactgcccagccactgggtccagtaagacagagcctcgagtcattctgccaagaggatccagaaacacagactttttctggggtcctggaggcttctggcccatggggagcccctgggtcccagcgatccagccctgatgtgctgagggtgcagggcccagctgcagagcagaggagagtggcccccagggaccagcagcacgaaaggcacactgaggcacactggcaggcctgggctgcagagagcctgaaggtcatggggtagctggtggaagcaggaagaccccatacagcagcgaccactgaggctggtgctgcactttctcagggaattgagtgtgggctcccaccatcccggccactggcttcctccaaagcctcctcctcttacatcagcaaaccttctgttcggtgaccccctcagtgaccctctgtgcttgccttcgtggtcttcctcatggaggatttcgggtcagcgtgggggtcagaggtcatttcccataccccctcaaaggtacttcttgctgtggtccccacactctgacaccctcttctgaaatgaacacttttttgttgttgttgttgagacagagtcttgctctgtcgcccaggctggagtgcagtggcacaatcttagctcactgcaacctccacctcccaggttcaagcgattttcatgcctcagcttcccgagtagctgggattacaggcatgtgccaccaagcccagctaatttttgtatttttagtagagatgaggtttcaccatgttggccaggctggtctcgaacttctgacctcaagtgattcgcccgcctcggcctcccaaagtgctgggattacaagcatgagccactgcgcccggccacaaacacttttttttttttaaacaagtgaaaacaagtttattaacaaagttaagaaataaagaatggctattccata

SEQ ID NO: 4140 - DNA, 2131 bp, Homo sapiens
  ENST00000618655
gctcctgcgccgggggcggggccggcgagggctgcctctggggggtccgctagtcgcggggcggcggcggcggctgcgggcgcgaggtgaggggcgcgaggtgagggtcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctact

SEQ ID NO: 4141 - DNA, 4810 bp, Homo sapiens
  ENST00000346248
gtcccctccctgcgccccgccgcgtctcgggaggcggcgtgactcgggagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaa

SEQ ID NO: 4142 - DNA, 3553 bp, Homo sapiens
  ENST00000628426
gactcgggagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgtgtaccccccccccccgtaccccccgagctggcccctggcagaaggagctggtttgttgttattatgcaagcggcattgtgggtttgcgtttcagcataggaacagagagaagcgttttaatgtgcaaatgctgttccccattattcatggatgtaaaagctgaaaactgatgggctcttggtctggctcctgccttcctccctgctggtcacctgccacctccccctcctccctcagcaggaggatgagggtgcctttaggaagattaccatttagcaagacacccagcaattagaatcggcagacatgaggacacccaactctcaaattgtcttaagagcattctcttgagcggtggattgttttgttggtttaaaaaactacccatcaatgattttcaatgcttctttgacagagtctcaattgaaaaacattttctgttgattcctcaatcgtatctcttgttcttccttcagaactatgtctgtaaatttctagcctttttgaatgcaaaaagctgttattggtgaattcagcaccttttagccccgggatagttttccatgctgggctccctgggctggctgtgtacttcaacagcagggcttatgcagcgagcattgccgctgcgtgttccagagtggctttacaagccttgctctgctcagcgtctcgcatagcaaggcaccaacaggcctgctgtggagtcttggaagcccccaggtggtgggacttcaggccaagaggctctgccccctctttcttactacagaggccgtgggatctgggaggcagcatgcaggggcagcaggtgggattccaggctgccctgttggactttgtagtttggcaaggaagatgccacagggacacaggtaaccccagagcctgctctggtgccaggtaggaggagtacactttggaaccagccattggtgtgggtcaggtttccagcttggccatttgctggctctgtgactctaggcagttgtctcagcctttctgagactcagttgctttgtcatacaatggggtaataatgctgctgtaccaggctgttgtgatgggtctgtcttgcattcctgcgttcattcttgccactatgtcccctgcatgacgctgggtcctggggccacagcaatgccaggacaggtgtggtccttgccttcctgtgcagctggcggggagagaagatggaggctgggcagggagctctggccaccagagaaccacctgagaacggggcttcaggcaggttcttaggagagggaatgtctgtgctgaggcctgaaggagagttggccagggaactgagagcagcgtgtgcagaggcccagtggtcagcaccacctaccatacagaacgcagccagccgcctggtgtgggagatggggggcactgaggcagggggcttgggtgcgtggcacatggggccgcaccacctggtctagcctcagaagaagtctagacatcaccctgagagagatgggacccctcagagggttttaagcagaagatagtgtaggagtggaaaaggaatatctcactactgtgttcatggctgaggcacctataataaaagactaacgcgagaaagca

SEQ ID NO: 4143 - DNA, 436 bp, Homo sapiens
  ENST00000476765
cgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgtgtaccccccccccccgtaccccccgagctggcccctggcagaaggagctggtttgttgttattatgcaagcggcattgtgggtttgcgtttcagcataggaacagagagaagcgttttaatgtgcaaatgctgttccccattattcatggatgtaaaagctgaaaactga

SEQ ID NO: 4144 - DNA, 826 bp, Homo sapiens
  ENST00000462406
cgctcggggagtcaggttgacgcgccctggatgcggggctagaggctcggggctgggcgcgctcccgcggagccggagccgcagaggctcccgggctggactcaggcttctcaggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaa

SEQ ID NO: 4145 - DNA, 4820 bp, Homo sapiens
  ENST00000435907
gtcactcccaaacttttcctcccagcgctcggggagtcaggttgacgcgccctggatgcggggctagaggctcggggctgggcgcgctcccgcggagccggagccgcagaggctcccgggctggactcaggcttctcaggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaagc

SEQ ID NO: 4146 - DNA, 3245 bp, Homo sapiens
  ENST00000336257
ctctggctgctgctccagctctggcagacacgccaagctttgagaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggtggtgagtcccctcagctggccaggacagtactctgctctcacctctctgcttcttgggctccatcccagctccccatcaactgatcttcttgcaaacccacagggctccaggacaccctccttctggagcccatgctgcctacagcacttcactccccaccagtgatgacaacagttgctgttctttgtccactttatttacttgtttatctttaatgacaaaagttttttttttgttgtttttttttttttttttgaaacggagtctcactcttcactcaggctgcagtgcagtggcgcaatctcagctcactgccacctctgcctcccaggttcacgccattctcctgcctcagcctcccgagtagctgggactacaggcgcccaccatcacgcctggctaattttttgtatttttagtagagatggggtctcactgtgttagccaggatggtctcgatctcctgacctcgtgatccgcccgcctcggcctcccataatgctgggattacaggcgtgagccaccgcgcctggctgacaaaagttttatacctgcctgttaaaaaaattatataatacagaagcacaccttgtaaaaggtgcaatcctcagttatgggcatgactgcgtgttcccttcccccatcttcattataataaccccccaatccccccagatcctgtgagccaggtaccggaattatccctctttcacacacgggtaaagtgatccgtcacagagagatttaagtgatcttcataagcaagatcataggctaggaagtggcagagccaggattcaacctcggcgagcctggtggtgctctgacatccaccgaagcccccatcaagcccttttagctccacaacctaaaagggtctctctaagaggtatcctgaagcaaaagacaggagttctctttgaaacatagtatttctctctacagatagatagcctgtaggtatgtaagtaggtgggtgggtgggtaggtagacagtttgatgatatcccacattattctgcaactggacttctgctgtgagcacagactatattctggcctatgtcttgactccgtattcctgggaaagtgctcgactgagaccttgggagtcttgggaagtccaatgggtagggtagccgaatctgagggctgatccctgagggcactgggcagtaattggggcatgggatgggcatgagggcccgggtccctaaagttgcccactccacccgaaggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcaggccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggagttcgaaaccagcctggccaacatagtgaaaccccctctctactaaaaatgcaaaaattagtccggcgtggtggcacactcctgtaatcccagctacttaggaggctgaggtgggagaatcacttggactccagaggtggaggttgcagtaagctgagatcatgccactgcaccctagcttgggtggcagagcaagactctatcaaaaaaataagtaataaatttgttcaaaagtcc

SEQ ID NO: 4147 - DNA, 514 bp, Homo sapiens
  ENST00000565039
aaagagctggctgtgcggtggaacttggaagagacgacgtctgggagcttttgctgagcccagggggagaggcgtccctctggctgctgctccagctctggcagacacgccaagctttgagaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggtggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagc

SEQ ID NO: 4148 - DNA, 1040 bp, Homo sapiens
  ENST00000591231
ttcgctgggagccttcccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccaggtttaaaggtcaacaagaatatcttaccttaatttgacaagtacgcaagaaataatgcaagactcgtttatgttcagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgcccc

SEQ ID NO: 4149 - DNA, 2133 bp, Homo sapiens
  ENST00000438847
ccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagca

SEQ ID NO: 4150 - DNA, 683 bp, Homo sapiens
  ENST00000604556
cggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggacagagacctctgcggtgtcttcaattaatggaagaccaccagcctgtattgcagagggtggcgtgcttctgcagcccagaagattagaggaaatctgggaattcaagactttcacaggcatcgacctacagtccccaacgcatttctcaggg

SEQ ID NO: 4151 - DNA, 2479 bp, Homo sapiens
  ENST00000262622
gggactcgtcccagagtttgctgccgccgccgccgctgccattagagcggttttaattagctgcaggatttttaatgagctgaaatcaagaagagccccatctcagaagtaagcgagagccgcgcgcagggaagaactagtctgacaaaacagaaggaggtggtgctctcgggggactgggctgtaggctcccaccgatcgatcggcgacgagcagatgagttcccgaggccaggaggctgaggagggaagccagggctcagagaccagcgcccggtgcagagtccccgctgctgccaccgcggcagaaggcacggtgccggattcaaggtgacggcagtgcctggctccattctcctcaagttgccatagcagcctctctcccaacaagcagcttctccgggagccctcagccgggagggacgtcattgttctctcctgcccgtgtggtgcaaggagacccaccggacagagaactttcccgagcccggggtccgctgaccacgtgggtgcacccatgctgcctggagccaggcacagggacaggtccccacggccacagggaatcctctgggcagctgaggggagcgtccaggcccagaagcagctgcagccaagcgtgtccttggagccgtccatgcgtctgtccgcctgctgccggtcgccactggagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagca

SEQ ID NO: 4152 - DNA, 2225 bp, Homo sapiens
  ENST00000434302
ttcgctgggagccttcccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccaggtttaaaggtcaacaagaatatcttaccttaatttgacaagtacgcaagaaataatgcaagactcgtttatgttcagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagc

SEQ ID NO: 4153 - DNA, 11388 bp, Homo sapiens
  ENST00000618847
gtcagggccagggtgagcgcccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcatgagtacagaaaaaatccaggaacatatcaccaaccagaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtgatattttggacttaggcattttactttagattggaaggcattatgtgatttacaatatgagaatatagcagaaaaaccagatgaggctgtggctttttatattcaacagccaataaaaaatgcacaacatgctaagatcaaagcaacaaaaccaaccttcttcttccagaaaaacttaagggaattgattctgttttcttttgagccttccacaaagagacaaaatgaacacaagcactaaaggtctacatttctgaagcaggcagttgagaagcttaagtctcatcagatataaatgtgctcctaattctggtttaattgagcaggggggaaattgtttcaggatggaataatcatcaaaaacaaaagttgccattctgaatatggaactcaaacaataacaaagttttataagtatattatttgaatcaaagcatcatgtgcatagctttatatgtggaatacaccctaagaatagcttttgttttcagtttaattattcagcttaggaatgactttttaaaaactaatataccacttcaaagataggttatgttctagagaataaacataaaaagagcccctagaaatgtgtttaataggcttatgcataagtaaattaaggtattttctttttaagtttaaatattctatactaacaaagtcagataccattgcattcaaatattaaatcaaagtccttagaaaaataggtccatgtgtcacccttatgaatagttgtaatgcattttggaatttttttccaagggatcctaaattagatcccttggggaaaaaaaaagggatcattttggatgggaaacatttggatgggaaacctactttaattggtcgacttttaccccgagttaagaaaatcacaagtctttcaaaccctgcttaaatgcttttcctgaacatcttcctcttcctaagctatcatttttttcttatcagtaaatattcagtaatggctttcaaagaacagtaggtattaatagttgaatgttaatagaccaagatagttgcagtcatacttatttcattttgattttctatttcatggctgagtattcatgaattgcttcgctccttacacacacctgccgtgtcccatctgtgtctcctaaggagtaagtaaactgcaatgggctgagagatcaaaagtattaaaccttctaatccaaccttttactacttttccatgccattaactcttgcctctagaccatacacttaagctgtgctctcagtttttaagacgttttactctggagtaatctaaattacataatttaaaattttgctgcaccatgtagagtagattcctagtaatttagggaaattgaaattatctttttatggagagagaaaataaaaaatattccagaagcctgaaattttattcctaagaaacacaaaacttgctttatatgaaatccactataaagaataaaggcaatttcctcaaaagtattcctaaaactatataaggaacagacaaagaactttcaatagctttagaaggaaaaaaatggaaacaacagtcctacctctcttattggcatttgtaatgcattgggcagggtggaatgcatacctatataaatgtttggctttgatggtggagaggagggatgagtggaagaaaatgatacccagtgttctctacggaaagctgtattgtaccttttgctgtatatgttcctttcctgaccctttccaacgagcccgtgtcaccatgggtcattcttttcctaaatgggctctatgatgccaagtgacaccctgtgtagttgcaagttccaaaagccatgcatgtctttgccaagtaagaacaaactttttatgtacctgctcttcattttagatggcttattttcatgttaggaccaaagaagccagtcatcatcctggattacttgtgagtttaaagccaaactccatttttctctcctgacttatttggccttgcagaccagctcacattcacctttgtcatttctgcctgtgcataaatccaggtgggaacaccactgttctttaggaccatcacaatttcatgaatttaattcctaaaggcaagtgaccaaatccagactcatcttccagatgtccaaagttcccattttaacattaggtgcaattataagtcctccaattaaaccctaaggatcctatttgtttttataggcagcagtaacacaatgggcagaccccttcgctctgttattcccctgtctggaattactatcagggtaacaagttggcaattaaatccaaaaccacagttatgtaacctgtaaactatctatagatgtgcaatattgatgtgattgtgcccagaaactgccataaacttcaatggaaatgtatgtacaggacatccagttttcggattttctcaaacatttggaaatatccattaattcaatggaaatgtgatgccacttgctagatgtctataaaacattctgtaacagaaaataataatattattatcattagggaattagtagttctaattcaagaactacttgtatgtcatttttaattagaaagaggaaaaatacttttacattttattgatgtattattattcttatctcctaaaatgtatagtatttagcagaaggtatatataagaagatgcagagaattttgaatattagagtgccctttgaaaaaatcacttgctgaattaatagaacttgggattaggctaggactacagtaaacgtctccctcctgtgcattctcatgtggcctctcagggcatcccagcctctaggccttcatggggcgtggtgaagcagatgttttgcccagggctaaccctcccaagatgctctgatacttgaaaaaggattggccaaaggcgtttaattatagctcaactacctgagaaccttaggccaaggctaattcaatttagtcctacatttaggctcataccttctcaatctcaatcatgatcattatacagtaatcgtatgcatgatcctagctaacatttattcaatacttactgggtgtcaggcactcttcaagtagtttacatgcattaatttaatctccatagccagtctaacataggtaatattatgtagccctctccctttccatctatcataaaggaaagtaaagcagactatagctgagtaacttgcctaaggagacagagatgataagtaggtcagaagccaggatgaagccaagcagcaaataccactaccaaactctttgcttagaatattacaaaccaatatttacttttgctttccgttacctctattcaggataggtagaggcaaaaacaatatattggaatcctgaaattttttccatacaaatatgggtgtctgtgtgtgtgtgtgtgtgtgtgtgtgtgtgtgtgtgtgtatttagctagttagttatcacatttcaaatcagcttatttctttattcctgctgagttaaactgacaggttcaaagactttggaagaaattaggtttcctccccacaacttttttgtaatccttagttaatcatggaaacaatgtttttaagaagaaaaaatagtccctggaacaaatttagccttgtgaaaacaaaatatcatttctttgacaagaaattccagacagctacaagaccagtcaaggataagcagaatctaagaggaagaaagttcaggcgaactttccacacataggcccctgacagccactgcagatggtcacggttcagcaagctagtcacacacagtgagaaccactcctgctagaaacagagcaactgtgcattatccccttcttcctgagtctccttccctagtactagtttgtagtcagattaccctgagcctacacgggaagactgcagaaaagaatagaggagcaagctgacttaaaccgactgaaaaaacaccatgaaaccaggtgaaaataaataagctcttgctagaagatggcagacatttcccaggcctgtgatcattacctgaggaaggccaggtctggggagttcaacagaacattgcctcatatcatttcattctcagaatttcctagtcagtcacatcttagtttttcaccaggatcatatgcttccaggcaaaagtatttaaatccatttaagcagtcatctttttccatccctaaacctctcctcaagtctcacactatatttggaatgctcccctctctatatatctggacattcatttcttgttaactcaccaaggaatctcttgagattattcaatttcaaaatctcatctctttatgagctccctgataggcagaaaaagacagcagagttttcccctggtgtaacatgcatcagattattctcttaccaataaatgcaggcattcctttcctcgattttttttgtcagggaggttcgttaatttatttgttcatgtgctatttatctcactttttatgaatataaaatatctgttgttgtcattggaatgtcttaggtcttccaagaggaaaggaactgtgtctgttgaatgcactttgtaccatgtctagcaaggcactcagtggaaagcgttactttaacagatgcttttgatgctgttgtttaaaggttcctgtacaacttcttttagtgtagaattcgtatatttctgcctgtgaccttcaggcatctataggaccagaggatctgaaaggaaggtgctagagcagggcagctgagggaagggagctgagccacacaccttttctacactaatagtcatcccttgacctgaaggatagttgcagacacagaaatcttttacatttctaagaaatagcagttgcttgattgtttggggaagaaaattttgagaaaaatgcatgattctggtcaacataagagccatttactgaggatctactcagtagcagacacgggaaaaatactttgcatacattcatttaatgacatgaagagtaagtctaaccgtttccaaaagtagctttcaaaaaaatcaaagtcgagtatttttccacctatcatttcatgaatgagaaaactgagtatcaaagaggtttaataacagtctctctggctccaaagctgagaccatacattggcagcccacggggtagatctggctacagatatgtttggtttggctgacagtgcattttatttaacatctgaattagctgccaacattgggcctcattaatgacaggggatttgttaccctacattctatatgcccacctgaaaatagttggacagaggcaaggtcagtccctttagatgaggttggagatctctagttgttcacactcttcactaatccaccatcactcattcaccttacttgcctggcccctaagcatctcacttttcaagtcctgctctgaagagtgtattccttcccccgccaagcttccaaaggaaatcaactcctgaacattatccttgaccctatttgtgttgtgcaggtagtgaggttatcccattccgggtttccatatccttgctcacagtgctgcttgccctttggtcctatatccagtgggatctccaaacagtatttcattgtttggggaagtctcttttgaccaatgacaaagatgttgggagaaatccagtacctttttttggcatctttctgtcgtagccactgggtcccctggcaacgacattccttcccacctctttctgcagagatgagtcattctcccaggctcttggagctctagtatctagggacagaaactggctcccactgctgcctctagactgctgttctataaccttcatccaaaaatctcttctgttttgcaggtgtgcccgcttcctcaactctaaaaatcacctgcttcccagccttctccgaagattcttctttctgatttataacatgcctctccaccctacttcctgctattatctgggtgattgtagcaccccctgtaacattctactctcttgcttcttaatgctctgacaacctcctcctcctcctcttccctcctcttcctcctcctcctcctactcctcctactcctccccccacttctatacttagagaggtggagaaaacaggagaagggataactacgacttttgtcctcaaataccaggaaaactagtaaaacacacagtatctcattttatgcattcatttgctgaaaatatttccaaagtttagaaaaatgatttttggatgtactatataataaataaaaatgcactcagaatgctagagtgtctaccaacttaaaagaacaatattatttgtttgactgtgattatccttaggaaaaaataagccctgatttaacttatcaatttctgaaaaaaatagtgtatggacgacctgtatcagaattaacctaatttttgttaaaaacatattcccagaccccatccaagatacacagaattggaatctctatgaaaaccacctgaaaatttcctttttaataatctcttggggtacttctcgtgtgtgtgtgaattttttaagtcctggttgattataaatgataatacaacctgctcttttcattctgtcactgtgttgaaaagttaacaactctcagctcagagaattgtcagtgggtattggtaccaaagtcctctgtgggattttgaccagcactgaagcagaaacttggcgtccgaagtctgccaagtgcaagaactagagctgaaatgatgaagtgagggacggggacagcactgggcactgcccaaactttttgaaagctttcagaatgaaatggggaaatggaaactttcctctgtttgaaatataaaagacaaatgtgtactgaaggcaattttggcaactcaacttcacattgaacaagtgaagacaatatgagtttctccaataaaaactaaaaagctgttttcaaattgacctaagatgattgaaaatggaaaatatttgctatttggttattagtttgagagcaagtgccccaggaaatattttgcaatttaacttaaatggttataatgtatattttcttgaacttcattaaaggatttgtctctttttgcctttctattaggttgaaccatatgacattgccaacatttgactgactctgacatataaacacagccctttcatgtgggtccactaacagttctgctgctacctacccaattctaaccacattggctctcctcagaactattggaaatagcctctgaatagaagtcctgccttttttatttatttatttaaaaattacttcttttctctttgcatttttcttcttttgatattttcaattgtggcaaaatccacataacataaaattttatcaccttatcattttttggtatccttttaatgaatattttcctatccctccccatcttacctatttttttttttgagacagagtttcactcttgtcgcccaggctgcagtgcagtggcaccatctctgctcactgcaacctccacgtcctgggttcaagctattctcctgtctcagcctcccgagtagctgggactacaggtgcacagcaccacgcccagctaatttttgtatttttagtagagattgggtttcaccacattggccaggatggtctcgatctcttgacctcgtgacccatccgccacagcctcccaaagtgctgggattacaggcatgagccaccatgccttgccaccattttttaagtgtacagttcagcagcatttagtgtagttgtgcaagcatcaccactatcccatcacataccttccttccttgtgaaaaatggatactctgcacctattaaacaacttcactttttgccctcccccagttctggcaaccatcattctaccttttgtctctatgaatttgataacttaaaatacctcatataaatggaatcatacagcatgtgtctttttgtgactggcgtatttctcttagcataatgtcctcaaggttcatccatattgaaggacgtaccagaatttttttcttttcaaggctgaattgtattccattctcattgcctggcctcaatctctcaagactataacccattcccagcttaatcacctgatagctgcatcaaacccactattatccagccacatggaaccattacattctctgaaaacacctcttgctttttcccctattttgctcacactattacacgacctgaagtgtcctttattcctctttaaggacctccacatgggtgccccctccaagagttgcctgccccgcatgaccatcccacattcagctcgctctaccctctctgcttggggactctcttccactctccttgctttagctccaccattaggctgatggttccgaaatctttttctaggctatgtttctatcacgaactttgattcagattcccagtttcttgtgggactgcttcatctagatgtctcactggagcttccaactcaacatgaccaaagctgaactcatcacctaacccccaaacctgctttctccttatttggtggcaacaccatccatctactccatcttctgagttaggaacctagaagtcaaccccgatttctccctaagctgactcctcacagccacagaattcagaaagcccattaacttcactgcctgactttttctcaagcttctcctctcctcccatccattctgctaatatctaagttcagactctcaccttctcctgtctacaactctacgataatcttgaacttctctcccactctcatttccctcaatgccatcctccatacagctgcccttgtaatcactttaaaatgcaaatccaattccagttctgtttcccactatacattctatatcctgcatgatcccaattcttctccaggcatatttctggccattttctgcctcctggcttaatctccaacagcctagaatggacataataccctaacattggatagttttcttcctcctgggtctactcagcttgtccctctattagggcacccacctaccccccttcacctccccaacacttcctaatccctaaactaagctcagggaggcatttgtcatctctgcctggctcagatgagatgctctgccctgagtactatgagagattgggaagcaggattctatgtaggatggttaggagcctggggcttgtcatgagtaagaactgggtttgaattccgtatcctcaactttcaaatgttgggacctctgaaattgctttaacttctctcagtgccagttttctcatctgaaaactgaggatagaatacctacctagtaaggggggtatgggaaatgcatgtaaagtatttaataagtgctcaataaaataaaaccattgatttatctca

SEQ ID NO: 4154 - DNA, 2043 bp, Homo sapiens
  ENST00000581714
agtcttttctgtcttcagagcattagtgtgcacattaagtcttcagccttgttgagatagtgaatatttatgccgtatttgagaattaatattagcagaaatgtacaatgtagatttctttttaaaattctaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcatgagtacagaaaaaatccaggaacatatcaccaaccagaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtg

SEQ ID NO: 4155 - DNA, 2033 bp, Homo sapiens
  ENST00000580774
cccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcaaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaag

SEQ ID NO: 4156 - DNA, 4550 bp, Homo sapiens
  ENST00000254190
ggcgagctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggagcctgcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtgtttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacccagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgttttttttttttacaattgttttaaagccatttcatgttccagttgtaagataaggaaatgtgataatagctgtttcatcattgtcttcaggagagctttccagagttgatcatttcctctcatggtactctgctcagcatggccacgtaggttttttgtttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacatacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacgattca

SEQ ID NO: 4157 - DNA, 1949 bp, Homo sapiens
  ENST00000543813
gacttaatgagaatgttggctctccttgcagcggacaagaaggacatttgctaatgaagactgtggaagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtgtttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacccagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgct

SEQ ID NO: 4158 - DNA, 553 bp, Homo sapiens
  ENST00000560766
aagaaggacatttgctaatgaagactgtggaagggtcttgcactgtcacctaggctggagtgcagtagtgcgatcatggctcactgcagcctcgacctcccaggctcgtgatcctcccccctcagcctcctgagtaactgggaccacagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacga

SEQ ID NO: 4159 - DNA, 564 bp, Homo sapiens
  ENST00000561414
agccctgaaacatctcacaggaagggagatggctttgctggagttgaaggatatggaggcactttttataacaaagattaagggttgtttcatggacagtggaaattaaatgaagtcatcagtgccactataagcatcttaagaaggtttctttgctgagttttttttaagcaaggaatactcttatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggact

SEQ ID NO: 4160 - DNA, 819 bp, Homo sapiens
  ENST00000561143
ggttgccagcacttcagttagacttgacacagaacagctggatttctagcttccctttaaacccggctgcactgggcctgtgtggcacgtcctggtccccccgagctccatcccttctggcttacatccaccttgtccctgacaaaagggtgagaaaaccacttctctgtaatgaactgaaacgctgcctaagtccgaatgggaagttgtcgctctgtagcagtgatggtctgtagctgaggctgaaccgtgtacgtgctgaaggacagtcatgtaaacagttaacaggaagaacgaggacttaatgagaatgttggctctccttgcagcggacaagaaggacatttgctaatgaagactgtggaaggtatttgttaaccaaagattagatatgggtagttgatggttattcccagctgggctagaagttcctgggaatagcgtgaccttggtattagcccctctcagattcactggagaatgacgcagagccctgaaacatctcacaggaagggagatggctttgctggagttgaaggatatggaggcactttttataacaaagattaagggttgtttcatggacagtggaaattaaatgaagtcatcagtgccactataagcatcttaagaaggtttctttgctgagttttttttaagcaaggaatactcttgtgagtattaagttaacctgtctagattgagttgtgttttcttctgcagtacttctaactttctgttttataatattcttctaggtgatgtgccaaattatagattattgaaataccttataataaaatcctcttaaactttgaa

SEQ ID NO: 4161 - DNA, 139 bp, Homo sapiens
  ENST00000559384
agagtggtgccctccgtgtactctcttggaggatgaacttggactgctgctccatcacactgtacttcctaacatggtccaagacaattcctgggaaagttcagttcttctcaagtgagggttctgacacatctgtacc

SEQ ID NO: 4162 - DNA, 3850 bp, Homo sapiens
  ENST00000305031
gggtggcagcctaggagcggacgcgttgccgccgccgctgctcctcctcctcctcctgcagctcctccagctgccgctgctgccgccgctgccgccaccgccgccgccgggagaagtttcactcccgacccttgctcggagccccggcccagagctgagcgggagcccggcaggcagctgcagcccgcggcagtcgaggcgtccgcggcgcttcgacctccagccggtgtcggcgcctaggcggccggctgcggccgcggctgggggcgcaaaggcggaggaggggcgggtgtgagccggggaaaccgcgtgccgcgccgcgacagcccagcgagcgtccgcgcccgggacagccgcgatggctgtgcgctctcgccgcccgtggatgagcgtggcattagggctggtgctgggcttcaccgccgcgtcctggctcatcgcccccagggtggcggagctgagcgagaggaagagacgtggctccagcctctgctcctactacggtcgctctgctgctggcccccgcgccggcgctcagcagccgctcccccagccccagtcccgaccacggcaggagcagtcgccgccccccgcgcgccaggatctccaggggccaccgctgcccgaggcagcacccgggatcaccagttttcgaagcagcccctggcagcagccacctccgctgcagcagcggcggcgaggacgcgagcctgagggcgcgacggggcttcccggtgctccagcggccgagggggagcccgaggaggaggacgggggcgcggctgggcagcggagagacggccggccggggagtagccacaacggcagcggggacgggggcgctgccgccccgagcgcccgaccccgggacttcctgtacgtgggggtgatgaccgcgcagaagtacctgggcagccgcgcgctggccgcgcagcggacctgggcgcgtttcatcccgggccgcgtggagttcttttccagccagcagccccccaacgccggccagcccccgccacccctgcctgtcatcgcgctaccgggtgtggacgactcctatcctccccagaaaaagtccttcatgatgatcaagtacatgcacgaccactacctggacaagtatgagtggttcatgcgcgccgacgacgatgtctacatcaaaggtgataaattagaagagtttcttagatcgctaaacagcagtaagcctctctacctgggacagactggcctggggaatattgaagagcttggaaagctgggactggagcctggggaaaacttctgtatgggaggacctggcatgatctttagccgagaagttctcaggaggatggtgccacatattggtgaatgccttagagaaatgtacacgactcatgaggatgtggaagtaggaagatgcgttcgccgttttggtgggactcagtgtgtctggtcttacgagatgcaacaactgttccatgaaaattatgaacacaatcggaagggttacatccaagaccttcacaatagcaaaatccatgcagccataacacttcatcccaacaaaaggcctgcataccaatacaggctgcataattacatgctcagccgcaaaatttctgaacttcgctaccgcaccatccagctccacagggaaagtgccctgatgagcaagctcagtaacacagaagtgagcaaagaggaccagcagctgggagtgataccttctttcaaccacttccagcctcgggagagaaatgaagtgatagaatgggagttcctgacagggaagcttctatactcagcagctgagaaccagccccctcgacagagcctcagtagcattttaagaacagcactggatgataccgtcctacaggtgatggagatgatcaatgagaatgccaagagcagaggacggctcattgacttcaaggaaattcagtatggctaccgcagagttaaccccatgcacggggtggagtacattttggatttactccttttatacaaaagacacaagggaaggaaactgactgtgccagtgagacgtcatgcctatcttcagcagttgttcagcaagcctttcttcagagagaccgaagagctagatgtcaacagtcttgtggagagtattaacagtgaaactcagtcattctcctttatatctaattctttaaagatattatcttcttttcaaggtgccaaagaaatgggagggcacaatgaaaagaaagtacacattctcgttcctctcatcggaaggtatgacattttcttgagattcatggagaactttgaaaacatgtgtcttatcccaaagcagaatgtaaagttggtcattatccttttcagtagggattctggccaagactccagcaagcatattgagctgataaaagggtaccagaacaagtaccccaaagcagaaatgaccctgatcccaatgaagggagagttttccagaggtcttggtcttgaaatggcttctgcccagtttgacaatgacactttgctgctattttgtgatgttgacttgatcttcagagaagattttctccaacgatgtagagacaatacaattcagggacaacaggtgtactatcccatcatctttagccagtatgacccaaaggtaacaaacgggggaaatcctcccactgatgattacttcatattctcaaaaaagactggattttggagagactatggatatggcatcacctgtatttacaaaagtgatcttctaggtgcaggtggatttgatacctcaatacaaggctggggactagaagatgtagatctctacaataaagtcattctatctggcttaaggccattcagaagccaagaagtaggagtggtgcatattttccatccagttcattgtgatcctaacttggaccctaagcagtataagatgtgcttaggatccaaggcaagtactttcgcctcaaccatgcaactggctgaactctggcttgaaaaacatttaggtgtcaggtacaatcgaactctctcctgacagtccaggcaacacattttgccttttttaaggggagtttacctcattgttggttgttgttatttttattgtattattgttattttattattattattgttataattttattttgttgtcctggtcttaaactactcttggttgtcttcctaagggtgtttgttgacctcaagcaagaagagtctgcagttcactgatgtttcagatttctactgaagtcaatatgttattacttttatataactttatttgagattgagttaaatcatagcaatcaaatgacttttgaaacgcattcatcacaagagacagcttagaagaatgttctcttggggcttaaagatgcaatatcgacttttatttggtttctcaaattcaatgtgatacaaatatttactggtgaaaggtaccacaaaagtgctttatgcttcctatggggaagggactctgtaacataaacttgagttttgtaatttatacaaggacttaaatatataaacaataattttcttcatctttagaatttttaaagtaaatgaatacctatgattgtatgtttattttttaaaaaaagttttaaaaattgaggagttttgttccacaagcaaccggtactggctaccctggtcttatgacaattatgagctcctcacaactgtctgctataaatgcgaatgaactttattttctcaaggaaatatgatttaattaaatattcatgtacattttagaagctttatgaaacaatgtccttcatttgctggcaagaagataaaatatgacagaacctgtttatttaaaataaaacacaggtatagcagtattctttttcaaaaacactga

SEQ ID NO: 4163 - DNA, 636 bp, Homo sapiens
  ENST00000507545
agaagagtttcttagatcgctaaacagcagtaagcctctctacctgggacagactggcctggggaatattgaagagcttggaaagctgggactggagcctggggaaaacttctgtatgggaggacctggcatgatctttagccgagaagttctcaggaggatggtgccacatattggtgaatgccttagagaaatgtacacgactcatgaggatgtggaagtaggaagatgcgttcgccgttttggtgggactcagtgtgtctggtcttacgagatgagctttcatgaactctcagtccacactgccatagatggtcattcccacagctcctgctctgcatggtgtagccccatagacagagatgcaacaactgttccatgaaaattatgaacacaatcggaagggttacatccaagaccttcacaatagcaaaatccatgcagccataacacttcatcccaacaaaaggcctgcataccaatacaggctgcataattacatgctcagccgcaaaatttctgaacttcgctaccgcaccatccagctccacagggaaagtgccctgatgagcaagctcagtaacacagaagtgagcaaagaggaccagcagctgggagtgataccttctttcaacc

SEQ ID NO: 4164 - DNA, 4088 bp, Homo sapiens
  ENST00000464728
gcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacgtgaggtcttgttctcactcaagtgtggctggcttcctctgttcccaagatggaagaacctgggcccagtgatttttgcacagccaatccactgggcctcggagacggagtgggctctggtttgcccttttgagttgtaggtggtgaactgagcacagggctgtgtgctactggtcccctgtgacctgtgaggcaggctaggggtccagggtgtcacctgatccaagtctctgttccctttcctaccttcacagcagctgacactggagtgcccctggggagggcaggggcctcccagatgggttgtggccagagccgtgggggtggagcccctggtgtgagccttgcggtcactcgctggcaggaagacgggggtggccattcatcctgtggcttggcatcccatggggcatggggctcatggtggcaggtggactgtccgtgcctggaggcggtgccctcaggctgtgcttcccttcccgtccttcccgcagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggtgggctccttgatgcctgggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacaccttt

SEQ ID NO: 4165 - DNA, 3090 bp, Homo sapiens
  ENST00000262315
gcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaa

SEQ ID NO: 4166 - DNA, 471 bp, Homo sapiens
  ENST00000570058
agtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggatcaaacggcctaggctgcaggtggtcaagaggctgaacttcagatcggaggagatggaggagccgccccctcccgactcctcgccgacggacatcaccccgccgccgagccctgaggacctc

SEQ ID NO: 4167 - DNA, 569 bp, Homo sapiens
  ENST00000563545
agtgcgcgacggcggcggcggcgcgggaggttcggagcgggagctcgggctcgcggacggtatggaggactacgagcaggagctgtgcggcgtcgaggatgatttccacaaccagttcgcggccgagctggaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggagga

SEQ ID NO: 4168 - DNA, 1110 bp, Homo sapiens
  ENST00000479976
agtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcctgttgtttgcacagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacgtgaggtcttgttctcactcaagtgtggctggcttcctctgttcccaagatggaagaacctgggcccagtgatttttgcacagccaatccactgggcctcggagacggagtgggctctggtttgcccttttgagttgta

SEQ ID NO: 4169 - DNA, 3172 bp, Homo sapiens
  ENST00000455171
agtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggtaggttggcggcattgccccagggcctccggagtgggcgcgaggctgaggaggcctctggttccctgcatgtgtctcccccagcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaa

SEQ ID NO: 4170 - DNA, 1801 bp, Homo sapiens
  ENST00000440239
gtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaagcaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggtgggctccttgatgcctgggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgca

SEQ ID NO: 4171 - DNA, 4494 bp, Homo sapiens
  ENST00000471202
gcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagctgacccatctggatggcttcattcctttggcacccctgtccagtctcccacccctcactggccagcttactggggttgtcccacccgggtccctgagcactgatgggggctgacgtgaatcctgtgacctaggaggggcccagaggcaattgtcctcccttccccacagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacgtgaggtcttgttctcactcaagtgtggctggcttcctctgttcccaagatggaagaacctgggcccagtgatttttgcacagccaatccactgggcctcggagacggagtgggctctggtttgcccttttgagttgtaggtggtgaactgagcacagggctgtgtgctactggtcccctgtgacctgtgaggcaggctaggggtccagggtgtcacctgatccaagtctctgttccctttcctaccttcacagcagctgacactggagtgcccctggggagggcaggggcctcccagatgggttgtggccagagccgtgggggtggagcccctggtgtgagccttgcggtcactcgctggcaggaagacgggggtggccattcatcctgtggcttggcatcccatggggcatggggctcatggtggcaggtggactgtccgtgcctggaggcggtgccctcaggctgtgcttcccttcccgtccttcccgcagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgt

SEQ ID NO: 4172 - DNA, 819 bp, Homo sapiens
  ENST00000491530
caggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacgtgagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaag

SEQ ID NO: 4173 - DNA, 790 bp, Homo sapiens
  ENST00000426047
caccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagctgacccatctggatggcttcattcctttggcacccctgtccagtctcccacccctcactggccagcttactgggggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaag

SEQ ID NO: 4174 - DNA, 568 bp, Homo sapiens
  ENST00000484349
gccgccgagccctgaggacctcgcagagctttggggccacgggtgtgtggcttggacatgggcgtcccatcccatctgtccagtgggactcagatggagcccatcccgtgccctggatgaggcctggggggtggggagggttccatggctgagagcagtctcggacacccatatccaagggtgaccccacgcttgagtttctgccactgagccccggtctctctccagagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggca

SEQ ID NO: 4175 - DNA, 711 bp, Homo sapiens
  ENST00000569270
gaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgct

SEQ ID NO: 4176 - DNA, 701 bp, Homo sapiens
  ENST00000567620
cttcctctgttcccaagatggaagaacctgggcccagtgatttttgcacagccaatccactgggcctcggagacggagtgggctctggtttgcccttttgagttgtaggtggtgaactgagcacagggctgtgtgctactggtcccctgtgacctgtgaggcaggctaggggtccagggtgtcacctgatccaagtctctgttccctttcctaccttcacagcagctgacactggagtgcccctggggagggcaggggcctcccagatgggttgtggccagagccgtgggggtggagcccctggtgtgagccttgcggtcactcgctggcaggaagacgggggtggccattcatcctgtggcttggcatcccatggggcatggggctcatggtggcaggtggactgtccgtgcctggaggcggtgccctcaggctgtgcttcccttcccgtccttcccgcagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggct

SEQ ID NO: 4177 - DNA, 607 bp, Homo sapiens
  ENST00000565787
cttcccttcccgtccttcccgcagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtc

SEQ ID NO: 4178 - DNA, 814 bp, Homo sapiens
  ENST00000461268
gcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagagcaccccacctgcaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatc

SEQ ID NO: 4179 - DNA, 691 bp, Homo sapiens
  ENST00000493715
cgtggagcagcggcggggatagactcccccacggaacaggggtggggacgccacggcctggactctggtgggcggaacttcctcaggcagtctaaggaggggctgagtgaggctggatccctttggttcctggaggcctcctgggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccg

SEQ ID NO: 4180 - DNA, 673 bp, Homo sapiens
  ENST00000498439
tggccttgtggcttttggggtttgcggttggagtgcccggcggctctctggccctgagcctggccccgctgacctgccctggtgtccccctgtgctgagcaggaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaa

SEQ ID NO: 4181 - DNA, 197 bp, Homo sapiens
  ENST00000564940
tgtctttataaagtcacacctttacagactgtaatcacgtgcgagtggagtggggttcacaggatggtgggagtggggccgggcgtgggctcataggatggtgtgagtggggccaggagtggggctcacaggatggtgggagtgggggacaatgacaacggccaggcgaccgcgagtgagagcgagggccaagtgat

SEQ ID NO: 4182 - DNA, 3555 bp, Homo sapiens
  ENST00000631357
atgcacgtgaatgcctctgcccgacggtgggggcggggaggggctgcagcactaccaggcccggcagccagtccgcgcagacccgcgccccgcacaggcccggtgggcaggccgaccctggctccgagcccctcccgcgcccacgcccacgccaagaccaacctgctgccgggccgtgcagtccaggcccccgatgccgtgcccggcgccggctccagccgcgcgcccgcgcgctggcgacccagagaccctggaagctccgctccggacgcctggcagcgcttccgccctgcaccgctgcgcgcgcagccccgcccccccccccggcccgcccccggcccgcccccgccgcggaagggcggctgcggcggccaatggcgagctccccaggacaggacgcgggggctgcggagcaggaactcgccccgcccacccctcgcgcagccccgcctccgccacgccaaccaatggcgcgcgccgccgggcacgccggctgctgattggcggcgcccggcacgctcggggcgggcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacgggttctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggagcagccagcatgtctctgtcctgacgtgccatgggaccccaggggatgctggcctggtcgtgctgcaggatatgggagacgctggcctgggcctgtgggatgtgctgctcctggcctggacccggagggggactttccctgggcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctag

SEQ ID NO: 4183 - DNA, 2988 bp, Homo sapiens
  ENST00000317063
gtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacgggttctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctag

SEQ ID NO: 4184 - DNA, 4486 bp, Homo sapiens
  ENST00000361786
cttccggcgggggcggggaaagggcgcatttccaagggcccttctaggagaacagcgtgcggtctccatggtgccgggtcatccgagtcgggtcacgtggctggcgaaagccgtcgcggaggcgtggggaggagaaatgggcgggaggctgtggggatagcgagacacccagcgacgacgaggttgtcatggtgccgcggggccgtgctcgcgcatgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccaggaactacttgcccattctgaattcttacaccaaaatagccccacatccaggcaaaaggggcctttcccttggcccagaagaaaaaggaacaagtggagtgcagaagaaaatctgtactgagagacttgggcctagcttgtcttccagtgagccaaccaaggctggtgctgtcccatccagtccctcgacgccagcaccacccagcgccaaacttgccgaggactcagctctgcagggtgtgccctctctggtggcaggtggaagtccacagactcttcagccggtatccagcagtcacgtggctaaagctcccagtctgaccttcgcttcccccgccagtcctgtctgcgcatcagacagcactctccatgggttagagagcaactctcccctttcaccactgtccgctaattatagctcacctttatgggctgcagagcacctctgccgcagcccagatatcttttcagagcagcggcagagcaaacataggcgctttcagaataccctagtagtcctacataaatctggtttgctggagatcactttgaaaaccaaggagttgattcgtcagaatcaggcaactcaggtagaactagaccagctaaaggagcaaacccagctgtttatagaagccaccaagagcagggcccctcaggcttgggccaagctgcaggcatctttaacacctgggtccagtaatacaggcagtgacctagaagcattctctgatcacccagccatatagcacagaggcatattttcctgttacttgagtggttcttttagctcatttgctgttacctactcctgtttcccaaagcttatgtaagagcttttccttctaaacttaaactgtgttgtggttcacttaggaagccacgtgccaatacctggctgctgtcttaactcgtagtctgggcacaggatacatatgtccccgtcccactgaggacctcagtttgggagtgcccttgagccccttttccttagcctgcaggtgcttcaatggatcatggggcaaagcaggagatgattgtgtggggctcttcctgctgtcacctcccatcatcccactctctcaccaggatcaagggtacagtaacacgaatgagcatacagagcaacacctgttgagccagggagtaggtgacacaaggaaaccttcatggatcttcccttgcctgtcttagtcacagagagaaataagaggaggttgtttgcatcccacaaggcatcgtactagttgggcgagacctaaaattccctgggcacaggttgcacctgggtgtgagcacttaatcactcaacgctttgttttcttacacttgaaaatcaagggaaagagtagtaccatctgactcctacactttcattacaagtcagatttttcttaaactagcaggcaaaaacagtacttccaaattttaaggtatggaatgaatgcagtacatctggaattgtagtcgatgaattgcttttttgacttagaagctgaagaaaatagacatagccggcatatctcatggtcaggagctggacgattctggtaacttaggctttttttctctcttcttttgaaacagtgtaacctgttttatgtctaaaaatcttaaggatagtttcagtggttcctgggatgtagtataagttaactctgctgccatcttgttttttttttttttcctttattttgataagtgattattatgcttgataaactttgaattaaatacagttgtcttgagggtatgataagtccacaaaaaattggaaagcatcttacccattttcttcacatcccaaatttttatttgttccatgtcatagtgatgggaagcagttacagagcagcgtcttctgtgtttccttcatgtgttagatattggcaacaaagccagaggtgtaatgttggttatatgaagttcatctcaaaatggagaccatgaccagagtttccagatgatacacgttcttttcagcttcattaaataggcaactatgtttctaaatagtaaagtttcaaaatattctctcaatttaaaatttcatcctcttgaaaatctttgttctttacaaaattatcttaataagttctatatggtcagcttcatcttccttttttttttttttgagatggagtttcgctcttgttgcccaggcggagtacaatggtgggatctcggctcactgcaacctccgcctcctgggttcaagtgattctcctgccacagcctcccaagtagctgggattacaggtgcctgccaccatgcccagctaatttttgtatttttagtagaaatggggttttaccgtgttggccaggctggtctcgaactcctgacctcagttgatccgcctgcctcagcctcccaaagtgctgggcttacaggcctgagccaccacgctcagctcagcttcaccctgtctgcaaagaaaagttttaccaagaccagaagttaaatatgacatttcctaggtagttgtaactctaacatagtttaaaaagtatgtggcttcagattgcctatactttgttcacaaacgtgtgatttagatatgactgatgtagaagtgaacaacttggtaacatccctagactccactcatgaacgcagaattattacctgctgtttgctttctgaaagaatttcagaaatcagagcaaatgtgtctttaggcagattcagctccttttaatatttttctcttggcccactctctttgcttcccctgaatctgtgtggtactatagcagctctactctgtgcaccatgctaggaagcttcctttttggcagaatatgtttggcagcaaagctatagagacaggtgcattcagaacatcctgggcaccagtcatgagtcttactgtgtcaaaaatctgaaaacacttgctgagaaccaaatttattccattggaaaaaccctctgtggagctataagcctcttggactcttcttcctagattaaggcttgcatttccctccctgtttcagtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctgtaagtagtgatggttttagcgatgaataacgtaattggctatgaagtactgtggcagagctgctgttttctgaaggtgagaagccatttttagctcagagcaacccttaagagaacttttggcagattttgttggcattattgaaatatatatagaaaagttgctgattgcaatggttatgggaatggaatttaatgacatttgtaatttattacactcattggtttttattgattatagtattgtctgactttttattttctactatggttcctttagcagaaaagtaacttttgtgcatatattgaagtggtttttcagctatgaattctttagggtagaaatttatttagcaaatgtgaattcttttgagaaagtatgaagttttgcagaaattgactgtgaaatgtcagagaaaaataaaagtcacttacttgaaaccta

SEQ ID NO: 4185 - DNA, 566 bp, Homo sapiens
  ENST00000555437
ttccaagggcccttctaggagaacagcgtgcggtctccatggtgccgggtcatccgagtcgggtcacgtggctggcgaaagccgtcgcggaggcgtggggaggagaaatgggcgggaggctgtggggatagcgagacacccagcgacgacgaggttgtcatggtgccgcggggccgtgctcgcgcatgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagggcagcagctcatcccagctccagtcgtggactgtccagccctcctttgaagtgatctcagcacagccacagctcttattccttcatccacctgtaccatctcctgtcagtccatgtcacactggtgagaaaaagtccgact

SEQ ID NO: 4186 - DNA, 538 bp, Homo sapiens
  ENST00000556863
gagacacccagcgacgacgaggttgtcatggtgccgcggggccgtgctcgcgcatgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcaggttaaaaatatcttatccttcctctgttttgtgagtgaatgctttgcgtgaaaaatttcctccccaaaactcatttatgtgataaggatgggatgctttcacacacaggataaatacttacctgctttaaaatggtaattctgatgccatatgtcagggtacccatcaaagtcaccacagggttagttctgaaagaattatttaacatcttttttcaacttagactctgaatcttacacttccaac

SEQ ID NO: 4187 - DNA, 599 bp, Homo sapiens
  ENST00000555611
gtcatggtgccgcggggccgtgctcgcgcatgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagcagtaatgagtagtgtgctgctctcctcctttgtcttcagggcagcagctcatcccagctccagtcgtggactgtccagccctcctttgaagtgatctcagcacagccacagctcttattccttcatccacctgtaccatctcctgtcagtccatgtcaca

SEQ ID NO: 4188 - DNA, 584 bp, Homo sapiens
  ENST00000554658
tgcgccacctgacccacaggccggtcgtggagctgcgaccccggccctaggggaccagacgtggaggttagatcttaaggtgaccgtggtgtttggaaatgcagaatcttgaccttcaagctgttcagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtacc

SEQ ID NO: 4189 - DNA, 882 bp, Homo sapiens
  ENST00000557115
gaaagggagggctcggtccgggaggaggggagcagggatgacggcgggagagggattgggcgaggagcgtggggaaaggaggtggaagtaggggagagaggaagaggagcgagtaggcaagaggggcaaaccgggactttcggaggacggagagccaaatggtgggagcagggctttggtttgctgtgaggggcgtgggagagggaatcgcgggtgaggagggggctgcgtgtggggaggaggcttgtgtgaggggcaggtgggccctggtctagccctgggcgcaaccgccagccggctgggcggggagagagcttggagtccagcccggctgggagctgagggccaagcaatgggcagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccaggaactacttgcccattct

SEQ ID NO: 4190 - DNA, 596 bp, Homo sapiens
  ENST00000554447
agttttgccctgctgagctggcaggctggtggatgcctggagggtgcacatgctgcctggcacagatgcaacgtgggctggtgcgaatggggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccagga

SEQ ID NO: 4191 - DNA, 581 bp, Homo sapiens
  ENST00000555200
agatgcaacgtgggctggtgcgaatgggggaccagacgtggaggttagatcttaaggtgaccgtggtgtttggaaatgcagaatcttgaccttcaagctgttcagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtc

SEQ ID NO: 4192 - DNA, 8708 bp, Homo sapiens
  ENST00000392521
ggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaat

SEQ ID NO: 4193 - DNA, 8578 bp, Homo sapiens
  ENST00000261833
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaa

SEQ ID NO: 4194 - DNA, 8520 bp, Homo sapiens
  ENST00000545913
ctggcccctggcaggcaggcggcagccaggtggggttccagccagagcacgcacgcacggagccgggagcatgcagcctgcactgcgggggatgtgatgctcggctctaactcgcctggctggcccgccacggacgcctcagcttgcaaccatggtaacgtttctggcgggggacacccccgggagcccaccgcgatgggcagcctcctggtgactgatggacgagtgtccacctcccagaccgagagcgcttagtaggtcggaggaagtggagaggatgtaacacgcccccagccgggagtgaagccctgaggaggtaggagccgcatatgtccatccgtgcattcccaccgtcagcgcgcaggggtgctgtagatcaccgctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaaggtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatgatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaact

SEQ ID NO: 4195 - DNA, 5205 bp, Homo sapiens
  ENST00000392520
cccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagc

SEQ ID NO: 4196 - DNA, 4958 bp, Homo sapiens
  ENST00000537607
aaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatgatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaac

SEQ ID NO: 4197 - DNA, 524 bp, Homo sapiens
  ENST00000544872
ttccctcttttcaccattctttggcccacactgtgcctgcatggtgatcacacagcctacagagaaccctatctgtttgtgacccacttcaactcactcgaagtaattgagatccaggcacgctcctcagcagggtaagcattgtcctcccatgcgtggaaaacttcagctattggggtaggtgttggggccggccgcatgttccttcctaacttgcctagcaatggaggtagcctgcaatgaaggtaactggaactctgggactctgcaggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccg

SEQ ID NO: 4198 - DNA, 441 bp, Homo sapiens
  ENST00000469414
agatatgtatttgttgggtgagttgctttacacaggattgctgggtcaaagaatgcattgcagtcagattttgattttccctcttttcaccattctttggcccacactgtgcctgcatggtgatcacacagcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagccccaacaagcgaggcccacccacgtacaacgagcacatcaccaagcgcgt

SEQ ID NO: 4199 - DNA, 533 bp, Homo sapiens
  ENST00000538073
tttccaggaataacttggccttaaccttctcttggtttctctggatggtttggtcataaacagatcagcctcacgatgtcttctgtttttcttttctttcacctatgaaaagaaactgcttggaaactccctgctgaaactggaaggtgatgaccgtctagacatgaactgcacgctgcccttcagtgaccaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcga

SEQ ID NO: 4200 - DNA, 497 bp, Homo sapiens
  ENST00000543324
ggcccgcgactgtgtttcttacgagcttctgcctgcctgggttcagaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaag

SEQ ID NO: 4201 - DNA, 564 bp, Homo sapiens
  ENST00000544800
acggcgcctttgcacttctgctgcagccttatgggggaaggagtctttcatgtgtcttattaaccctgcgcaggtgaaatctccttagcttcagcttatttcttattacagaatagctttccatgtctactaccctcccttatttctgcatcccagccaaattataactcagatgctaattaacagctgccccagagataccaatagcactcgcattttgcatttggagctcagatcaaaatacgggctgagctaagagcatatgtgcgtttctgagcatttccaggaataacttggccttaaccttctcttggtttctctggatggtttggtcataaacagatcagcctcacgatgtcttctgtttttcttttctttcacctatgaaaagaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttcca

SEQ ID NO: 4202 - DNA, 586 bp, Homo sapiens
  ENST00000543239
ctttctgcaggggcctggcaccaggggaagctcaggagactacctgcaagccagggccagactctctgggcccggctggggtagagaagcccaggcgttggctggcagaggaagggaagggtccagggtcagctgagcatgccctcaggttgctcactgttcttccctagaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcac

SEQ ID NO: 4203 - DNA, 567 bp, Homo sapiens
  ENST00000536008
actctctgggcccggctggggtagagaagcccaggcgttggctggcagaggaagggaagggtccagggtcagctgagcatgccctcaggttgctcactgttcttccctagaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaaggtaaattaataattcagggggaaggtcattgcacgtggctaacccaggtctccccagtgctggcgcgaaggctttgttttttggactgccttgcaagccttctacgcttttccatttttgaaacttacaaaccaaatgacttctctaaaggttattggtgcgatactcacatctataggtctcc

SEQ ID NO: 4204 - DNA, 594 bp, Homo sapiens
  ENST00000544588
acatgccatttttactaaatacacttacagtgagtatgctcctggcttttgtggtttgctcctcccgagtcagatttcctttagctagtttcaagtgccagtttccaggagttaggagatatctctgtttccattgctagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcat

SEQ ID NO: 4205 - DNA, 329 bp, Homo sapiens
  ENST00000536325
atagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggttctctattctcatgaaaaggtgaaaatggaaggcactatttctcaacaaaccaaactcat

SEQ ID NO: 4206 - DNA, 677 bp, Homo sapiens
  ENST00000546026
ggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaagaaatccttgtttaaagacaaggcacaaatcagtgctactgatttgcagacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaag

SEQ ID NO: 4207 - DNA, 590 bp, Homo sapiens
  ENST00000541841
agttggagggaagagggaaaatactcatcttttcagaatgggaataggacaaatgaaggagagtaaaacttcatcctttattgctttttttcccttttctcctaatagcctgtaggtgttaatataaatgttaaaaatatttgtacagggtgtgcatgtatggtctaaagaattaattgttattaacacagcattgtgtattcctgtaacttatttctggtgttggggatgatttgattaattagttcttagaaaaacagatgctggtgccgcattctcggctttccaggcaaattgctattctctatatttgacccgtagcatgtagaattgtattctaccctatgaaaaatttataatcaacttcttaccttttaggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccggga

SEQ ID NO: 4208 - DNA, 2283 bp, Homo sapiens
  ENST00000488203
agcgccgaaggagtaagacgatcttctccgcaacagtgttgaatccggctgaaattttttttcctccccgcctcctttcttgtttttctttaaccagctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcaggtaggcctgcttgcctgggagcacagcagcatctcggcttgcttggacctctaatttcaggagaggcgtgtttgagagagaaataggaagaaagggagagagagaaagggtgggggcagagtggaagagagacaggtatgtaggtcattcagaaacttcagatttctcataatttatatacatcatagaatgcttgttccagctccttttgaagctgataccccataatgtctgcttttaaaaataaagatgtaggtttagagcaagagtgggcagacttcagcctgtggggcaaagctggtccaacacctattttctatggcccacaagctaagaatggggttacgtttttaaacagttgg

SEQ ID NO: 4209 - DNA, 554 bp, Homo sapiens
  ENST00000539413
actgggatcagcactggcccctggcaggcaggcggcagccaggtggggttccagccagagcacgcacgcacggagccgggagcatgcagcctgcactgcgggggatgtgatgctcggctctaactcgcctggctggcccgccacggacgcctcagcttgcaaccatggtaacgtttctggcgggggacacccccgggagcccaccgcgatgggcagcctcctggtgactgatggacgagtgtccacctcccagaccgagagcgcttagtaggtcggaggaagtggagaggatgtaacacgcccccagccgggagtgaagccctgaggagctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagct

SEQ ID NO: 4210 - DNA, 1799 bp, Homo sapiens
  ENST00000612548
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcga

SEQ ID NO: 4211 - DNA, 1116 bp, Homo sapiens
  ENST00000453782
cttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctc

SEQ ID NO: 4212 - DNA, 632 bp, Homo sapiens
  ENST00000437924
actttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcga

SEQ ID NO: 4213 - DNA, 563 bp, Homo sapiens
  ENST00000475589
gaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggtaacagtgcctgaggcgcgggaggaggcgggggcaggaggtgatgggaacgaag

SEQ ID NO: 4214 - DNA, 800 bp, Homo sapiens
  ENST00000481666
ggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattccccctcctcccgcggagcaaagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggac

SEQ ID NO: 4215 - DNA, 542 bp, Homo sapiens
  ENST00000449946
gtgtttattccgcggtttccccgcggctgcccccgggagaccgaagaggtggctggggcaggccgaaagcagaggaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagccagacatggccaactggacagctcccaggtaactgcactaggtctaggcgtctgtgccctccctccatggttactgggtaccccctccccagcgctgagtacccagacctccgaaagcacaacaactgcatggccagtc

SEQ ID NO: 4216 - DNA, 593 bp, Homo sapiens
  ENST00000417289
gtttattccgcggtttccccgcggctgcccccgggagaccgaagaggtggctggggcaggccgaaagcagaggaaaggttgggcagtgtcacccttgcacacccacaggtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaaga

SEQ ID NO: 4217 - DNA, 1747 bp, Homo sapiens
  ENST00000441322
agacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 4218 - DNA, 599 bp, Homo sapiens
  ENST00000495545
actagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattccccctcctcccgcggagcaaagccagacatggccaactggacagctcccaggtaactgcactaggtctaggcgtctgtgccctccctc

SEQ ID NO: 4219 - DNA, 670 bp, Homo sapiens
  ENST00000498538
actagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaagtcagaactggccgaagcatccgag

SEQ ID NO: 4220 - DNA, 801 bp, Homo sapiens
  ENST00000453733
attgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgagga

SEQ ID NO: 4221 - DNA, 2396 bp, Homo sapiens
  ENST00000437534
attgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttgttgtggggattaagtgaaatacaggtaaagtacttggtccacagtaagtgcttaataagtgttaaagtgttagctgcaatattattctggatggaagagtttccccccatgttcagcatgtaagatatcccctatggcatggttccttctgaactataaagaggatccctttactcatgttgggttgtggtctttgtgaccatcattctgctagatcccttgtctcttgaactctaatagtcatcttcatgactacatggttaagtgaagccaaacgccttccccccgccccctattcctatgaatctggcttttctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 4222 - DNA, 545 bp, Homo sapiens
  ENST00000428981
ttgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggtatttgctgacctgtttgaccctgtgatccaagagcgacacaatggatatgacccccggacaatgaagcacaccacggatctagatgccagtaaaagtcagaactggccgaagcatccgaggactcagtctgcctccagcttgcactcgagcagagcgacgagaggtggaacgtgttgtggtggatgcactgagtggcctgaag

SEQ ID NO: 4223 - DNA, 260 bp, Homo sapiens
  ENST00000411560
ccttgctatgctgcagctgtctgtgttacttctaatggtggggtgaggagggagcagccttcaggaaatgaaaagaggcagtgggattatttatgatggaaagagactccagatatggcaacccaggaacactgattctcaggaatccaaccaaagggcctaaggtctccagcacttcccctgagactggagtctcctttggagcctggagaagagcatcagaacttggacaatgcacttctgactcagaataccagaca

SEQ ID NO: 4224 - DNA, 1779 bp, Homo sapiens
  ENST00000300283
cttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 4225 - DNA, 1074 bp, Homo sapiens
  ENST00000627381
cagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttgttgtggggattaagtga

SEQ ID NO: 4226 - DNA, 2234 bp, Homo sapiens
  ENST00000221455
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 4227 - DNA, 1941 bp, Homo sapiens
  ENST00000391953
tttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagt

SEQ ID NO: 4228 - DNA, 582 bp, Homo sapiens
  ENST00000592056
atttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatgtaagccacctcccagggggttgccaggcacagcgtcatacccaggagcccctgttcttttcccagcctacctgtcaccttcctaggagccgttcctatttggtaccgccctgagcctgagggggatgcctcatttcccttcctgctggcttggggggggatccactccttctctctgatttcaaggtctcgccc

SEQ ID NO: 4229 - DNA, 572 bp, Homo sapiens
  ENST00000591410
atttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatctctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctct

SEQ ID NO: 4230 - DNA, 2213 bp, Homo sapiens
  ENST00000391952
gcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaagtcacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 4231 - DNA, 599 bp, Homo sapiens
  ENST00000588247
gcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcgtgagtaactggccttttgtctggggtgagggaccctgggttggggggcacagctggtcatcctggtaaaatctgggcttggaagtatgtcaagacaagaggctcatttcctcaggagtatattcattaatcttttcttgaggataatcattggtgggatcccaagggcttctgtttgttgtagcatactgtgtcgtttggtgtggcctcccagtgccgatccggtgttagcaagaaaaagggaagtctctgtaaccctcagagcagtcctgacgttagactggccacctccagaatgtctgtttcgcttattgctgtgttccccattcccagaagagctcagccactcttgagatttggcttggcacacaataggagtgagtattaagttggcctggcacagtggctcacgcctgtaatcccaagtggatcacct

SEQ ID NO: 4232 - DNA, 590 bp, Homo sapiens
  ENST00000588936
gcgcgagcgcagcggtgggaggcggcgaccagccgcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctgga

SEQ ID NO: 4233 - DNA, 2769 bp, Homo sapiens
  ENST00000544944
ctctttttctttggatgctctccccaccccgccatctagatcccatctttagacctcagcttcactctggtctccttgcaacactccctccccgtgttcccactccctctagcatcttcatcttccgccacgcccttcacctgtcctcgacctccaccttcatacaactgcactgttcccttaaaagctttctccgatttcctccacctgccttcatccttattctccttatccctctaccacccagactcatacccaaccccacgcatggcccctagtgggagccttttcagttcttctctttctcttgagctccagccttaagtgctcagggtttgccttctgaccctacttcaaacactgctgatgtttcaaaacctttcattcccgactccagcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaagtcatcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgt

SEQ ID NO: 4234 - DNA, 867 bp, Homo sapiens
  ENST00000587112
aagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgagacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctccc

SEQ ID NO: 4235 - DNA, 967 bp, Homo sapiens
  ENST00000588016
gcagggggacaccaacaacatgattgaccgattcgatgtccgtgcccacctggaccacatccccgactacaccccccctctgctcaccaccatgtaagccacctcccagggggttgccaggcacagcgtcatacccaggagcccctgttcttttcccagcctacctgtcaccttcctaggagccgttcctatttggtaccgccctgagcctgagggggatgcctcatttcccttcctgctggcttggggggggatccactccttctctctgatttcaaggtctcgcccttccctaaagctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcggtggggtcccctctctgccctccccacctgcagtccctgggcatcgtttctgtgtctcgtccctcaccctctgtggggcaccccgtgcttacgaaccgtgtctctctccctaccccgccccagggcacaccagcctcctgctgcccctgtctcactcctgtcctcctccgttccggccttcctctgcctcactcatctctcatttctagggtgctatttctatgatcttttcccctcctaggtgttggctccattctcctccacttgggccggcctctctctgcctttgcccctctctcctgctctcttccctcctctggaaaacaagtgttcatcctcttacagagtcagcccc

SEQ ID NO: 4236 - DNA, 290 bp, Homo sapiens
  ENST00000585432
gccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaagtcagtaagaatttggaactcgcccgtctaattcccgtcagcagcagtgcccaagagctgggcccggtgggcctgcaggggggcccgggtgggctgggagatccagccccagggacagggagggga

SEQ ID NO: 4237 - DNA, 633 bp, Homo sapiens
  ENST00000585615
agaaccatgtccctctcccctcctcactgtacactggggctccacctgtcactgaacctctgggagcctcagggctgtccacagcctgcccctcctccccacgtcgttctcccccccccaccccccccccgcacaaagccccaggcttttggctgaggtgggttgtgggagctctgggacacccaccccctctcccgcctcttctcccccctccccagcccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagtta

SEQ ID NO: 4238 - DNA, 506 bp, Homo sapiens
  ENST00000591904
cccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtc

SEQ ID NO: 4239 - DNA, 345 bp, Homo sapiens
  ENST00000587472
gcggcacaagaaaagatgatccagcaggagcatgagcggcaggtgaagtgggaaagggagggctggggtgacgggtgggtgctggcctggccacgtcctcatagccctgtctgctgcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaa

SEQ ID NO: 4240 - DNA, 751 bp, Homo sapiens
  ENST00000592876
ggatttgacaagatcaaggccaggcacggaggaggcacccagtagacgtagccattgggttgccaagcctggccactgtgacggagaccatttcaacactcactgtgtgcaggtgccccagtgcggcaggaaatgatgggactatcctgcctccctctgttccccaggctttcctaggaaggggctgggattccagtcagccccgccagctggggtccctctgaacctggggctccctttccaagcggggattggtggcagtaccggcccccttggtttactgtcttcctcggagtagggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtcgagaatacagctcttctcgaaggtaaggaagcccatgaccctccactttcttggaagtaacacttgtcctttgatgggaggtcctggctgtcattcctccagcctcaccctgtacccacctccagttggaggggctggtctcatcccttggggaacatccttccctccacagacaagtgccccgatcactgaagcatccacggccccaggtgtgttgatgtgtgtatgccccatcctcacggcccctccctttctctttccaggcgctcaaggtcccgatcccgaagcc

SEQ ID NO: 4241 - DNA, 445 bp, Homo sapiens
  ENST00000588070
cagtcagccccgccagctggggtccctctgaacctggggctccctttccaagcggggattggtggcagtaccggcccccttggtttactgtcttcctcggagtagggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 4242 - DNA, 3172 bp, Homo sapiens
  ENST00000343257
agcaagagcagaggcttaaggagctacactgggggaaggacaggggcaagcaggccaaggcctggccggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgtccaccccacacagatttatggccatcacaaagaacaattctcagacagggagcaggacatagggatgcccaagaagacaggctccagttctaccgtggacagcaaggatgaggatcactattctaaatgtcaagattgtatccaccgcctgggacaggtggtgagaagaaaattaggggaagacgggatctttctggtgcttctgggactgctgatggctctggtcagctggagcatggactacgtcagtgccaaaagccttcaggcctacaagtggtcctacgcgcagatgcagcccagccttcctctgcagttcctggtctgggtcaccttcccactagtcctcatcctcttcagcgccctcttctgccacctcatctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagggccccttcgtccacattgccagcatctgtgctgctgtcctcagcaaattcatgtctgtgttctgcggggtatatgagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgctgtcaccatcactgctctgttcagaaccaatttccgaatggatttcccctttgacctgaaggaactaccagcttttgctgccatcgggatttgctgtgggctcctgggagctgtatttgtgtatctgcatcgccaagtcatgctcggtgtccgaaagcacaaggccctcagccagtttcttgctaagcaccgcctgctgtatcctggaattgttacctttgtcattgcctcattcaccttcccaccaggaatgggtcaattcatggctggagagttgatgccccgcgaagccatcagtactttgtttgacaacaatacatgggtgaaacacgcgggtgatcctgagagcctgggccagtcagctgtgtggattcacccccgggtcaacgttgtcatcatcatctttctcttcttcgtcatgaagttctggatgtccatcgtggccaccactatgcccataccctgcggaggcttcatgcctgtgtttgtgctaggagctgcatttggaaggctggtaggagaaatcatggccatgctctttcctgatggtattttgtttgatgacatcatctacaagatcctacctgggggctatgcagtaattggagcagcagcgctgactggtgccgtttcccacacagtctccacagctgtgatttgcttcgaattaacgggtcagattgctcacatcctgcccatgatggtggctgttatcttggccaacatggtggcccagagcctgcagccctctctctatgacagcatcatccaggtcaagaagctaccctacttgcctgaccttggctggaaccagctcagcaaatataccatctttgttgaggacatcatggtacgtgatgtgaagtttgtttcagcttcttacacatatggggagttgcgaaccctgctccagaccaccacagtcaagactttaccactggttgactcaaaagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggctccccggcgcgcctccaggccggcccgagtccttcgcctttgtggatgaggatgaggacgaagacctctctggcaagagcgagcttcctccttcccttgctctccacccctctactactgcccctctgtccccagaagagcccaatgggcctctgcctggccacaaacagcagccggaagcaccagagcctgcaggtcaaagaccctccatcttccagtccctgcttcactgcttgctgggcagagctcgccccacaaagaagaaaacaacccaggattccacagatttagtggataacatgtcacctgaagagattgaggcctgggagcaggagcagctgagccagcctgtctgttttgattcctgctgtattgaccagtctcccttccagctggtggagcagacaaccctgcacaagactcataccctgttttcactccttggcctccacctcgcttacgtgaccagcatggggaagctcaggggcgtcctggccctggaggagctacagaaggccattgaggggcacaccaagtctggggtgcagctccgccctccccttgccagcttccggaacacgacttcaactcgaaagagtaccggggcacctccatcttctgcagagaactggaacctgcctgaggacaggcctggggccactggaacaggggatgtgattgctgcctccccagagacccctgtgccatctccttccccagagccccctctctccctggccccaggcaaggtagagggcgagttggaggagctggagctggtggagagtccagggctggaagaggagctggccgacatcttgcagggccccagcctgcgatccacagacgaggaggatgaggatgaactgatcctttgaccccctcccacgacctcctcataaagaccgtggagaggcccagcctgagggtgaacttgtgtggggcagggtgcgtcctgaatgtggcgaggtcatgccaatgtcgtggcctcttcca

SEQ ID NO: 4243 - DNA, 491 bp, Homo sapiens
  ENST00000432192
catctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagcctgtgcctgtcctccaaatgtccacccctctttcacctgtggccccacatggagaccgtgcctgggcagcttgacctcctggtgtcggcctgtgcagtgggcgtgggatgctgctttgcagcccctgtcggagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgc

SEQ ID NO: 4244 - DNA, 569 bp, Homo sapiens
  ENST00000455478
catctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagggccccttcgtccacattgccagcatctgtgctgctgtcctcagcaaattcatgtctgtgttctgcggggtatatgagcctgtgcctgtcctccaaatgtccacccctctttcacctgtggccccacatggagaccgtgcctgggcagcttgacctcctggtgtcggcctgtgcagtgggcgtgggatgctgctttgcagcccctgtcggagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgc

SEQ ID NO: 4245 - DNA, 278 bp, Homo sapiens
  ENST00000495612
catctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagaggagtgctatttagcatcgaggtcacctccacctactttgctgttcggaactactggagaggattctttgcagccacgttcagcgcctttgtgtttcgagtgctggcagtgtggaacaaggatgc

SEQ ID NO: 4246 - DNA, 582 bp, Homo sapiens
  ENST00000511092
agcgcgtggaaggcggcacgcagcggaggcggctgggaaggagcaataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttg

SEQ ID NO: 4247 - DNA, 6692 bp, Homo sapiens
  ENST00000513761
gtgacgtcacgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaatgtgtggtttggcctttaattatatctgtaacagtcctccctcttcactgctgccctacgcagtgtaggccgatatgcctggcacagggagccccaaaaaggtaataattataatgcttctctcaggttacaaagcatttctacactttgcaagcaaggagcaatagaagagtagatagatgctggattgacagcaggatgttcataccaccagcaatggtttagcgcccccatttgtcagtgaaagctgcaggtccacagaaaactgatttcatttcagctcactttcaaaagtgatttttttttttttcgcaagaaaaattacgctatttgcatgaaaagaggtaaaacgatttatttacatgtctttaaaaaatcaccttggacatttgctaatagaactgccaaaagagggtggtaagtaacaacctttgattaagatgtggtcttttactattaagcttttagtaaaaaggaacacactaaaa

SEQ ID NO: 4248 - DNA, 3635 bp, Homo sapiens
  ENST00000347613
gtcacgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggattgtcttggggatcatcacaaagaagaacatattagagcatctcgagcaactaaagcagcacgtcgaacccttggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctct

SEQ ID NO: 4249 - DNA, 3208 bp, Homo sapiens
  ENST00000360642
acgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagc

SEQ ID NO: 4250 - DNA, 563 bp, Homo sapiens
  ENST00000512813
tttcgggctcctgactcctgccgcttctcttccccttccgtgggtcagggccggtccggtccggaacctgcagcccctttcccagtgttctagttcgcccgtgacccggaataatgagcaaggagggtgtgataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatc

SEQ ID NO: 4251 - DNA, 567 bp, Homo sapiens
  ENST00000506924
ataacaagtgcaagtagtgatgaggaacttttagatggagcaggtgttattatggactttcaaacatctgaagatgacaatttattagatggtgacactgcagttgagacggggtttctccatgttgctcaggctggtctgcaactcctgggctcaagcaatctacctgccttggcctttcaaagtgctgggactacaggcgtaagccaccgtgcccgtcctcacagggcttttattattaacattcttcaatatctcctacttgaatcacaagattccacaatgacaccattattatatagtataaacattgattatttgtgatgttctggtaggattcataggtgtattttagactatcttcgaatagatggactgtatagagagtttcaggaggtcatcaatgtatattttttctgaggtttgatatatattaggtaacagtgattttagaattataacagagctatattataaaagagtatattatttacatttagctagtttttctttagcaacagaacacaacccagctgaatgtaagactgaatagaagccaccagaagt

SEQ ID NO: 4252 - DNA, 2485 bp, Homo sapiens
  ENST00000507875
agttttgtgtgttgtacttggagcttagtcattgtcatacgtagcaggacctgattaagaaggctgtgccgcctctaagccttgctagattgtagccactagcaaccaggctgcaataatttccctttgatgacatcatccactgtggaagaacccagttgcttcagcgagtcgaactacagttttaacctcatcaaatatggcatctcccttgcttgctgcagcagggatggaagaaatgtcactttctttttaagctagcaagctttttctttttctttttcttcttctatttaaaaattctaatcatggatgcttcttccgacccttatttgccttatgacgggggaggagacagtattcccctgagggaattacataaaagaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaag

SEQ ID NO: 4253 - DNA, 493 bp, Homo sapiens
  ENST00000502998
caaatggaggcagcattaacagttctacacatttactggatcttttggatgaaccaattccaggtgttggtacatatgatgatttccatactattgattgggtgcgagaaaaatgtaaagacagagaaaggcatagacggtttacttataccctgtaactttccagaaaggatttcaggtagctaaaaaacaaagaaatacaataagaagacaaaataagaaggaaagggaaaaatacagcacaggagttggggggaagaacaagccaagttccagatatggaggtcagcatgattttgggctttgagcagcccaccagctaaggcaaaaaaggaaactcattgcatagctcttacctatggaaaaagaagaaatctactgggggcagatggtcttgtgggattttgctgttttcttttatctcctttcccagcatttgattctgagatatttctcaatttggctcccaaataaagcttattgagtgttgtaa

SEQ ID NO: 4254 - DNA, 735 bp, Homo sapiens
  ENST00000515420
ctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactg

SEQ ID NO: 4255 - DNA, 5874 bp, Homo sapiens
  ENST00000613795
agttttgtgtgttgtacttggagcttagtcattgtcatacgtagcaggacctgattaagaaggctgtgccgcctctaagccttgctagattgtagccactagcaaccaggctgcaataatttccctttgatgacatcatccactgtggaagaacccagttgcttcagcgagtcgaactacagttttaacctcatcaaatatggcatctcccttgcttgctgcagcagggatggaagaaatgtcactttctttttaagctagcaagctttttctttttctttttcttcttctatttaaaaattctaatcatggatgcttcttccgacccttatttgccttatgacgggggaggagacagtattcccctgagggaattacataaaagaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaatg

SEQ ID NO: 4256 - DNA, 5592 bp, Homo sapiens
  ENST00000504131
atggtgaagcttcctataggagagtctcactatgttgtccaggctggtctccaactcctgggctcaagcaaccctcctgccttggcctcccaagtagctgagattacaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgac

SEQ ID NO: 4257 - DNA, 10108 bp, Homo sapiens
  ENST00000376088
gtcacatgagccgcgcgcccgcttcgctccccctcctccccggctgggctgtgtgaatgaagctctgccggctacgtggggcgctcactcaacttggtgtcctggacgccagagccgaccgagcgcgctgcccaccggcggcggacacgggctccgccgctccggacctcggcgacagagcaaatcagttgcctggagttcccagtgaagttgtacctgtgcccgtgcgataacgtcagtggaagctgccccgagtaagtgagggaaatctagaagtttggagcataaaaaaccagcacgaatcaactttacataaacttcatacatttattagcaactgctcgggtttaacttcagggatgttaaatttcgcctagtcccacgggacgatgatcattacttcttaactgcacgcgaaataggagaagaaaaaaggcaaatcaaaacagactgtcccaggtctcagagaagtcatcggagcgctttttcctgctgaattcaccctaggagtttgtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcatctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggttattttatttttatctttaaaataatcaaggcagtcgctagagtttctccttgtgaatagatcactctagcattttaatgaaaaagaaaaaaatctttctggggtatgttgtatcatagtaatggctcagtaaccacatattttgtcctttccatgtcactgattccttcatatgagactatttggcttgactaccctgtatattgtgtagaaatcaaagttcttatctgtacatttctggtccaatacctgtcttattagttgtccttccccactaaagtttgcaaaacagaaaatgttactatttctggtatttaatgacaatgaaaggtttggtcatatttcatagtgcagtagcgataaggagggtgtctcaagtttgcttttgtgtttcttctaggctttgttcttgattttagacagatgagccagtgttaaggtgctacttcagagaataaattagagaaatcagataacactgtgccaaggtatactttgtagatgctaagcaccgattggccctccagagaatgacaatatccctttgatacctcactcctgatcaatctcattcattaacctcagcttctcaggaatccttgtagcttgtatgctagaagtagctatggtatatggtatccactatatgtccagtcctatggtttggctcaaaggttggctaattgcagctagagctctcaactgctagctcagcaccttgacatttgaagtttcttgtcttgaggagaaggaaaatgttctttctgccattgccactttaacagttggacatgcttaagcaacaaatacagccagtatagggaggactgtcagtagcatcaaatggccacatacctcaatggcaaaagactagatggtttgtgatttaaaaattaatgagtcgagatgagactattttggtattaaatgagaaaattgcctaacacaagggaagggtttacaaaagaatgccaattagtgtttcaacagagttaggattttccaagtaagagtagctggtagccatccagccataaaaggaacgagagtctatagatttgtaaaagtaaaactgctatattttgtatcttcaaatcttcaatataaagaatttaaagaacctgaaacagttaatgcatgattcgttatattggagggaaaaagcaggggactgataatacaaaataatggcaactttaaagatcatttctacgtggatgtttggttagaaacatattccaatgctctcctctttctctggccacagcatcctggctcagcccagctgtggagtagaggtggtaagatccacagaacagatatcctctggtagataagctgacattgatgatactttgaatttaccagctggtgaagcaaacgattaatttgtgattgaactgaaaagcagttgaattgttttgacaccagaggctgaatctaaaccctttacaggaagagcagagcatactatacatttcttagcagatcttcaattctgtttgaacatgatgaagtaaccagggtttagtgagatctaaggccgtgaagtaattcacaaccaagatcttatgaacgcattcagatgtgaggggggcaaatatgttttcaaaaacttagtgtgcaatagagtccattatagaaattaaccactgctatatgttttaagtagttcaatcacctgttgtggttcagtcttgattattgtttattttgttaggtgataagtaggaagatgcacttgttatcccacactatctcttgttttgttttgttttgtttttaaataatgaacagtgcaatctttgaacttgagtttttaataatgatagcaaagacaatggtgagaacttgaaacagccagcatattttatattgccaaagtacttactgatgactgaccacactgtcttgtgaggaactgggtcccctgcactggatcagagccaaatgcaagccacccatcagttcagaggaagcaggaaaacatcttttgggtggtgcatagaacattgagctcttaaaaacccggagaaaaattaggaatttagaaagtaagtgggaggtagaatattgagtccttttttaaaaaaaagaattgatgtctaaatatgtagtctgaacttaagtgtcctaaaaccttgttttttgtttttttgttttttgaggagtcgtcttgctctatcaccaggtgggagtgcagtggcacaatctcggctcactgtaacctctgcctcctgcctcccgggtccaagcaattcccctgcctcagtctcccaagtaggtgggactacaggcgcacaccaccatgcccagctaacttttgtatttttagtagagacggggtttcaccatgttggccaggatggtctcgatctcttgacctcgtgatccacccatctcggcctcccaaagtgctgggattataggtgtgagccaccgcacccagccaaaccttgatttttttagccacctctgggattgcctgggttccctttggagaagaaactaaaagttatggccatagaaaaagccctggtaagaaaatatttgaatggtgtaagatggtggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagtttaaaaaaaaaaaagatctctgcctctcttctctctgcctcgtcccaccttgctgtctgtctcattgtctttctctcccctcaccatgcgctgaattcagatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctggctccaactgcagtagccaaagaaaacctgtctgactcgacattttaatgcctgagagttggtgaaagttcagctgaagctaatgtctagacatcagcagtaactaggcatccagaaagtagcttcaaccaaagctaatagagcccaagtttccgcaggaagtttggtgctgagctgtccagagcagttgtttatctgagtgttgctagcccttagccatgctttcttagctttattctcgcctgttcctaggcatagcctgaaccagagctatggctcactgctcgctttattctactccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctg

SEQ ID NO: 4258 - DNA, 3046 bp, Homo sapiens
  ENST00000376091
gtgtgaatgaagctctgccggctacgtggggcgctcactcaacttggtgtcctggacgccagagccgaccgagcgcgctgcccaccggcggcggacacgggctccgccgctccggacctcggcgacagagcaaatcagttgcctggagttcccagtgaagttgtacctgtgcccgtgcgataacgtcagtggaagctgccccgagtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcatctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattat

SEQ ID NO: 4259 - DNA, 449 bp, Homo sapiens
  ENST00000482218
cagagcaaatcagttgcctggagttcccagtgaagttgtacctgtgcccgtgcgataacgtcagtggaagctgccccgagtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggaggtatcattattggtgatgataatttatcttaattttttaaaatttatgtacaataaaattttatttttttttaatttta

SEQ ID NO: 4260 - DNA, 2660 bp, Homo sapiens
  ENST00000376108
gggaacactggtagttctttaggtggcgtttgttgctgtgaaaggcagagaatgcagcaagtgcccttctaaagcacttcagactggggcttcttttgtaaaagctccccaacctgaatgaccaaatgcgggctgccaaggttatttcttccttgaggcagaaaaaaagaaaactgtgattgaagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcatctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaa

SEQ ID NO: 4261 - DNA, 3177 bp, Homo sapiens
  ENST00000307367
tgatgtgatatggctgcaagtgcctttgacccttttgtctcccttccataaactgaaatacctaagctgctccaacctcctttttgtcttttgtttcataaatcctttcccattgcacatcaactcctgtctctctttgtactgtcactctcatctgttgctttccattcacactgcctttagccactcatcattttgtgcctacaccacagaaacctctgaatgtaatggatgttcctaccagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcatctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaattta

SEQ ID NO: 4262 - DNA, 3481 bp, Homo sapiens
  ENST00000295522
ctttaaatcgcggcgcccagcggttctgcgtctcagttcccgagcctgggagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaacaaaaaaaatgttaagaaatgggtttcttgccttaaccagtctctcaagtgatgagacagtgaagtaaaattgagtgcactaaacaaataagattctgaggaagtcttatcttctgcagtgagtatggcccgatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccactgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaatttaaaaaaaggatta

SEQ ID NO: 4263 - DNA, 432 bp, Homo sapiens
  ENST00000490800
gtttttctggagaagatactgtatattgggttaccagcggaaacatcagtatgactggggtctctagattcctagtccagttttctctcttccatacaacagtgacatatacttggtcttcttccatttttctcttgttggtccaagcatatttttacatgttttaaaatgttttctgccaggcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccag

SEQ ID NO: 4264 - DNA, 2169 bp, Homo sapiens
  ENST00000064724
agcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatacttttttttttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtctgcaaaa

SEQ ID NO: 4265 - DNA, 1139 bp, Homo sapiens
  ENST00000486975
agcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctgggctgtcagcttctttgggcaaagactgagtcatctctgcattctcagcacctggtgcaatttaagcagaaatatcttgaagatttttcgtatcttcagggagattaggaatgggaatggaatgggaacgccaatgcaggaaggatgagaagtctgcagatgcctccaaggagtccgaaaccaagtccgaagtcaacgacaagcaatgatggcgatggcgatcctagttaataaaaaggggggagatgtgggctgcaagccacccaggtgccgaggcaagagaccgaggacatgagctgttccagtataataaaatataaaacaagaatagttataccagatatagatcttagatatgattatatatgaatataattaatcattagtttgtggcaattactctttattccaatattataataatcctcgctctataatcataacctaggaaaaaccaggccatacagagataggagctgaggggacatagtgaggagtgaccagaagacaagagtgcgagccttctgttatgcccagacagggccaccag

SEQ ID NO: 4266 - DNA, 998 bp, Homo sapiens
  ENST00000486429
ctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctgggtaagacagctttctcagtggtaccctacctatgagggagcctgatgaatctcagatcttgtggttgctgccttctcaagttcaagagaaatgtgaaaggaagccaagtgaagccagtgggggatggactcccacaatctgtatccctttgtattttatgggcagtttacacagagggctaagtaatgtctctgggagtcactgaccatgaagataagtttaaaaagagaaagaggattttgaaggtaggaaatacctaagggaaagacctgaaagatggaagccttctcagtcttcacagtggaatcctttttgaacacctatgcccaggtcccacagcagatcaattgaatcagaattttctgggcatcaggccaggcaaagatattttttgaaagcttcccaggtgatgctt

SEQ ID NO: 4267 - DNA, 1854 bp, Homo sapiens
  ENST00000489485
gcaggaacagtcctctgtccctatcttttggtgtccggacatggccttggcactgtagcatgtggacagccagtgccatggatttcagaacctgcattgccagttgactgcctgctttgtgctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatacttttttttttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtc

SEQ ID NO: 4268 - DNA, 593 bp, Homo sapiens
  ENST00000468358
atcttttggtgtccggacatggccttggcactgtagcatgtggacagccagtgccatggatttcagaacctgcattgccagttgactgcctgctttgtgctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagc

SEQ ID NO: 4269 - DNA, 571 bp, Homo sapiens
  ENST00000471373
ttggtgtccggacatggccttggcactgtagcatgtggacagccagtgccatggatttcagaacctgcattgccagttgactgcctgctttgtgctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggtgagaaaagctagaatgtggagtcctgtcatcagatgatgtgactacatggaatgaggactatagctgctctcttaaaaacctgcagccccctctctcagcccagacagttgagctgcttcagttgtcaggatgtttacacggaagaagcactggaccagttatgctgggctcctgtttctactccatccctgtagattcagcatccttgtttctaaaataaaagtattacaccaaagactctcttacggatctcctaactctgaccctctaggattccatctgttatattgaactttgtagtattttttgct

SEQ ID NO: 4270 - DNA, 1065 bp, Homo sapiens
  ENST00000477531
tggacagccagtgccatggatttcagaacctgcattgccagttgactgcctgctttgtgctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagagaagtctcggtctgttgcccaggctggagagcagtggtgcgatctcggctctctgcaacctccgccccttgggttcaagcgattcttgtgcctcagcctcccaagtagctgggactacaggacattcatgctcatgacatcacatgctgagaggacagggaggccagtgtggggctggcctcgaagagaggcggcatcagtgctaccattgagatgtccccacaaaagagtgtgtgacagccagatgtgcagcttaatggagactgaaccaggattgtgggtggaacattggcacatgctgcttatggcttgaatagcagctcttgaggaatctatatttctctacctcatgcagaatcttagagctctggctttgtggctccatggctgggggagggagtggagacggaggaacttgtcactgctccatgccccattgttgaaatggaaaatgtggaaatgttaagccgtttctagaggattgtggaaggtaagaattgcttccaaatataaaaatacaaatacaaaagatcacctgatcgtcacagttgggggctttcttgaataaaaatggttatatctcta

SEQ ID NO: 4271 - DNA, 600 bp, Homo sapiens
  ENST00000488989
atatttctctacctcatgcagaatcttagagctctggctttgtggctccatggctgggggagggagtggagacggaggaacttgtcactgctccatgccccattgttgaaatggaaaatgtggaaatgttaagccgtttctagaggattgtggaagggggagttaactgtgaaggcacttaacaatctccttattgaggaacgcgggactttgtttccaatggaggaatttctggcatcagagagcagatagggcagaggtgctttcttctgcggctcctcaaggctcacagcttgctatggaagcatccttggaggacatctccttccctgccctttccatcaacgttggttaatccaatctccaccttctcttaaaagattgacatgacgagtgaggaagccaaggacattgcatccgcatcttaaacttaatctcagtacatgaaaggggctgctttggaaatagagcttcatgaaacagggaaatcccgtggccaggaaacccctcgctcctccccaccccaccctgtgaggagtgtctccactaggaaggaaattaaatcagtcttccagccaccagaattgaattgggatggac

SEQ ID NO: 4272 - DNA, 1589 bp, Homo sapiens
  ENST00000480067
cgtagcgttggtacgtgctttggtgcagggcctcttctcgagcgctgatttccagggtgctgttccagatgccatatccaaaataaatgagcagacctgtggggcgaggggaaagataagtaaactgaggcccaaagaagttaagtaaatttcccaaagtcacaagacaaaggaggggcagagctgtgatttgaagttggtgctgtttgactccaaaggctgtcagcttctttgggcaaagactgagtcatctctgcattctcagcacctggtgcaatttaagcagaaatatcttgaagatttttcgtatcttcagggagattaggaatgggaatggaatgggaacgccaatgcaggaaggatgagaagagagtgtctgcagatctgataataactgtaaaataacatggccacactgagatacagagggaaggttaagcctccttgaacttacttaaattggtggcagcacgagctttcagcatcatggccagcatgaccaagccatttccctggtgttcccctcagcatgaaacatctgtctacttatttctttgctgagcctgaatggaatattccatctctgaaaaataaactttgtgtttaaattgaaatctttattcctatctggcaaattggctatatatcctcaacaattggaaggaagtgatgtatctgctgccatcagctacaaagcactggacgcccactgtgctatttattagatttacatgaattccaggtgaatctgatccagtggctacaaaaaaagatctgaaacttctataagcccagcatctaaatcagtttttgactgaaatgagtacaggcaagctctgaggcagctctatccagggctatgacaagaatgaagtgaacacattttaccctacatggaaatgtccattccaacaagtgctaatttgacaatggtaatgattactatgggttgaattggattatcccaaaagatatgttaaagtcctaacccctggttcctgtaaatgtgattgtatttggaaataggatggatgcagatatcattagttaacatactggagtagggtggatctttaattaaataaaactgatgtctttgtaagaagagaagagacacagacacagagggaagatgaccatgtgaagatggaggcagagattgaaattatgctgccacaagccaaggaactcttggggctaccagaagctggacgagggcaagggagaattgcctgtagagcttcgaaggggacatagctcttctatcagcttgatttcagaattcctgcctccagaactgcgagacaaaaaagctctgttgttttaagccacctagtttgtgttactttgttatggcagcccttggaaattaacaatgattataatagtaatatgaataatagcaacagcatctcatttactgttttctatgtgttaataacaattccaagtgctttacacatattatgggctttagggtctcattttacagataaggaagcaagtagagaaagcaaaagaaagacattgaaacgtgcaatggggaaatttgtttccatacaaataaaacaaaccatctgaggagcctt

SEQ ID NO: 4273 - DNA, 1359 bp, Homo sapiens
  ENST00000422142
gccgagtgcgcgtcgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgcccgcagaggctgaggcccgcggccccgaggggctgctgcggcgatccgggtcgggctacgagggcagcaccagctggaaggcggccttggaggacaccaccacacgcctcctgctgggtgccatcgcggtccttctgttcgccatcttggtggtgatgagcatcttggcttccaagggctgcatcaagtgcgaagcgccctgcccggaggactggctgctctacggaaggaagtgctacttcttttccgaggaacccagagactggaacacaggcaggcagtactgccacacccacgaggcggtgctggctgtgattcagagccagaaggagctggaatttatgttcaagttcacgcggagggagccctggattggactacgcagagttggggacgaattccactgggtcaacggggacccgtttgatccggacacgttcaccatcgcaggtccaggggagtgtgtcttcgtggagcccaccaggctggtgtcgacggagtgtctgatgacccggccctgggtgtgcagcaagatggcctatacttgaggtgggtggggccagaggtggccccgcccctaggcctgtgggaggtgtctggtgtctgctcaagacctgcttccagcggagccgcctgccctctgcaaggcgaagcggtgggtgcgtggcctccgccccaggcccctctcccaggccctggcgctctgagtccctggttcctggcctcctttgtctgcaggcaggtcgtgtggctcagcagttaaatcccatatgctaggtagtgtaggcatctgcccacctacacacacacacatgcataggtacacgcacgcacagacgctgtcccttctgaagctcagtgtccatcctgagccaccccacagatctctctccggccccctagaagccctctcctcactgcagccctggtgctctggggaaggaggggcattgacaggtggtttgactgttcacccagcagccccgcttccccactggtttctctcctggctgccggcggaggtaggctgggaaagcttccccctcacctaggccgggccagccccgccccgggccccagaggtcccctgcatcccccttctttgccttgcctgggttctcaggcagggcccctgctgtgtccgtggtgctgttgtattggtcactaacggaataaagagttaatatctc

SEQ ID NO: 4274 - DNA, 324 bp, Homo sapiens
  ENST00000521281
acgagggcagcaccagctggaaggcggccttggaggcttccaagggctgcatcaagtgcgaagcgccctgcccggaggactggctgctctacggaaggaagtgctacttcttttccgaggaacccagagactggaacacaggcaggcagtactgccacacccacgaggcggtgctggctgtgattcagagccagaaggagctggaatttatgttcaagttcacgcggagggagccctggattggactacgcagagttggggacgaattccactgggtcaacggggacccgtttgatccggacacgttcaccatcgcaggtccag

SEQ ID NO: 4275 - DNA, 2190 bp, Homo sapiens
  ENST00000520413
acaaaaagtatgcttatggaatttgcagctgacaaaatccaaaaacacaatcccatatgacagatgggtgaaagaaatcaagattaaaatgtatcttgaataactcaaatgatgagccaaagtgaatgacataaatgtggaagaaataaatataaggttctgcatttggatttaagaagttattttcacatgttctgacactgggggagacctggcttagaatcagatcatatgaaaacaatctaagattgtggattaattccttttggcaaggaggccctttgagaagctccgggcttccttcccagaaaagtccatgtatgcacatacccgccgatctgttcgtggaagcagtctgcagactggagatcccatgacgactggaagacagcatggtggtcactgttgctgctggtagagccacatctgatgtgtcccggtctgtcctggtggcagcgattcagtggtaacatggggacattgcagcgagcaggcaggatggagagcaacccttgtcaggaatcatgggagagatggcatctgtttcaacctggatgagggaggctggtgtgcttctttgagtagggggtagaagacagagcgggtgtctctgggtcactccagaggccttagaccagcaggtctaggtcacagggggacaggttgggactcaacatttaagaactttccatgcacactgacagcaagggggttaaaaaaataaaaatgaaaagaacttcccagcagttcagtggtggaatggcagccttggtagctaacatgggcatggttaatgacagcgggcagtctgtcctgctgttggtacctggcctagctggaaggagaggacacatagccgccagacctcttcccagtctgagtttctggcgttccatgcctctgggagtttggagacagaggagatcctaacccaggggctgccctgctgtcacttcccgtcgtgatgatgcccctgccaggcttcccacagtcccctttctcattcatttagtggccacccttttacctccaggcaccaggagaggacagccacatctgcagtgtccctgcaggacgccaaagctgaggcaggggagggagccacagaaagcagagtgggactcgggctgggggggcgggcagggccgagctggtctcttccctgcagcttccaagggctgcatcaagtgcgaagcgccctgcccggaggactggctgctctacggaaggaagtgctacttcttttccgaggaacccagagactggaacacaggcaggcagtactgccacacccacgaggcggtgctggctgtgattcagagccagaaggagctggaatttatgttcaagttcacgcggagggagccctggattggactacgcagagttggggacgaattccactgggtcaacggggacccgtttgatccggacacgttcaccatcgcaggtccaggggagtgtgtcttcgtggagcccaccaggctggtgtcgacggagtgtctgatgacccggccctgggtgtgcagcaagatggcctatacttgaggtgggtggggccagaggtggccccgcccctaggcctgtgggaggtgtctggtgtctgctcaagacctgcttccagcggagccgcctgccctctgcaaggcgaagcggtgggtgcgtggcctccgccccaggcccctctcccaggccctggcgctctgagtccctggttcctggcctcctttgtctgcaggcaggtcgtgtggctcagcagttaaatcccatatgctaggtagtgtaggcatctgcccacctacacacacacacatgcataggtacacgcacgcacagacgctgtcccttctgaagctcagtgtccatcctgagccaccccacagatctctctccggccccctagaagccctctcctcactgcagccctggtgctctggggaaggaggggcattgacaggtggtttgactgttcacccagcagccccgcttccccactggtttctctcctggctgccggcggaggtaggctgggaaagcttccccctcacctaggccgggccagccccgccccgggccccagaggtcccctgcatcccccttctttgccttgcctgggttctcaggcagggcccctgctgtgtccgtggtgctgttgtattggtcactaacggaataaagagttaatatctc

SEQ ID NO: 4276 - DNA, 2446 bp, Homo sapiens
  ENST00000353231
atctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaa

SEQ ID NO: 4277 - DNA, 3725 bp, Homo sapiens
  ENST00000534609
tttcctgctcttgaatatctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggtgagtatttggtggaggagattaacaacagacaatttagtaagcaattattatgtgccaggcactcttttaagggcttgacatgcataatctactttaatttgtatataatctggttttatctgtattgggttggtgctgttaatgcccatttcacttataaagggtgtgagagactgagaggttattttacctttccagggttataagctagttagtggtgggaccatgattagaaatttgggtgatctgtctaaaaaactcatactcttaactacattgctctcctacctcccttacatagctggtttcaaagctgtggaattcaaaggataaattaatgaagaaaacaagcggagctgaagaagaaagtacaatatggtgctgtcttcctaatgaaataaattcactaaatggacattaagctatttttatgattcacattatttaaggaaattatttccgatctttaatataaacacctttgaatacaccagaaatttcctgaggcacttggtcttaagtcgatattttgtaatggattaatattttttttacattttatatcacatgcaatctgttgtcagtcaccttcagagagtcttcatgacattccttaattagtcaaatgtttattgagtgcgttctatgttataggtactgggcagtttctcaaggatctctcatttttaaataacagaagaaaggtgaaagatgttgctatttcaaatctgtcatgggtccaattgactctatgacatttgcctcttgctgcctccctcattctatttcttcttctccaccttcttttttcttttctttttttttttttactatacctcctttataaaagttatgtatttcttttcatctattctatcaatcgtctttatctctccacagcaatatatcatctatttatcattaatcaataatgtattcttttattccaataacatttgggttttgggattttaattttcaaacacagcagaatgacattttttctgtcactattattattgttggtatgtgaagctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgagtctcactctgttgcccaagctagagtgcagtgaagccgcgacatcccaggctcaagtgatcctcccacctcagcttcctgagtagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaa

SEQ ID NO: 4278 - DNA, 1592 bp, Homo sapiens
  ENST00000529761
atttcctgctcttgaatatctggttgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaa

SEQ ID NO: 4279 - DNA, 1154 bp, Homo sapiens
  ENST00000298523
agacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataag

SEQ ID NO: 4280 - DNA, 1000 bp, Homo sapiens
  ENST00000396484
atgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgcca

SEQ ID NO: 4281 - DNA, 1130 bp, Homo sapiens
  ENST00000304084
ggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatc

SEQ ID NO: 4282 - DNA, 881 bp, Homo sapiens
  ENST00000465100
atggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggtactgggcagtttctcaaggatctctcatttttaaataacagaagaaagctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgagtctcactctgttgcccaagctagagtgcagtgaagccgcgacatcccaggctcaagtgatcctcccacctcagcttcctgagtagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaa

SEQ ID NO: 4283 - DNA, 355 bp, Homo sapiens
  ENST00000349926
atggaatatcatcctgatttagaaaatttggatgaagatggatatactcaattacacttcgactctcaaagcaataccaggatagctgttgtttcagagaaagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaa

SEQ ID NO: 4284 - DNA, 625 bp, Homo sapiens
  ENST00000533022
atggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgatttcagatcagaaccacagctacccaagaaaacccatctccaaattgtgtatggattcacgtgtcagtcatttatgaccaactgtgtagtgtgccctcatatagtatttgtgagaagaagttttcaatgtaa

SEQ ID NO: 4285 - DNA, 915 bp, Homo sapiens
  ENST00000531192
tttcctgctcttgaatatctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgagtctcactctgttgcccaagctagagtgcagtgaagccgcgacatcccaggctcaagtgatcctcccacctcagcttcctgagtagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctcc

SEQ ID NO: 4286 - DNA, 1006 bp, Homo sapiens
  ENST00000528799
gatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattggtaagtgtagacttctgttatgattatctgtggtgtgtatcctgaaggaagatagagggagattccaggtaatgacaatttttcctaaaatgaagtctttttttttttttttttttgaggcagagtctcactctgttgcccaagctagagtgcagtgaagccgcgacatcccaggctcaagtgatcctcccacctcagcttcctgagtaggtaggactacagggtgcaccaccacactcgtctaatgtttttttgtatttttcatagagacgaggtttctccatatcatctgggctggtctcaaaatcctgggcacaagcgatctgcctacctcgatctcccagtgttgggattacaggtgtaagccaccatacttggccaaaattcatttttaatatctctataattataatcatagcatgccttaagcacataaagtgcatagtatatgcttttatttttaactaatttaaaaaactgtgtttcgccttaaaacaaatcctttcaaacatactccatgtatgcatgactacaataatcaggacactacc

SEQ ID NO: 4287 - DNA, 425 bp, Homo sapiens
  ENST00000310002
ccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctggtttcaaagctgtggaattcaaaggataaattaatgaagaaaacaagcggagctgaagaagaaagtacaatatggtgctgtcttcctaatgaaataaattcactaaatggaca

SEQ ID NO: 4288 - DNA, 573 bp, Homo sapiens
  ENST00000525605
tttcctgctcttgaatatctggttgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggtgagtatttggtggaggagattaacaacagacaatttagtaagcaattattatgtgccaggcactcttttaagggcttgacatgcataatctactttaatttgtatataatctggttttatctgtattgggttggtgctgttaatgcccatttcacttataaagggtgtgagagactgagaggttattttacctttccagggttataagctagttagtggtgggaccatgattagaaatttgggtgatctgtctaaaaaactcatactcttaactacattgctctcctacctcccttaca

SEQ ID NO: 4289 - DNA, 6023 bp, Homo sapiens
  ENST00000185206
attgttagagacctgtcattgatagcagttgctagttgctgccttttaagagctcgttgattcctctgcaaggtggtgcagcatcctctgtcccttcattcatttcagatctactcaggtctccctgtaaacagatctctcggatcaataagcatgaatgacgaagactacagcaccatctatgacacaatccaaaatgagaggacgtatgaggttccagaccagccagaagaaaatgaaagtccccattatgatgatgtccatgagtacttaaggccagaaaatgatttatatgccactcagctgaatacccatgagtatgattttgtgtcagtctataccattaagggtgaagagaccagcttggcctctgtccagtcagaagacagaggctacctcctgcctgatgagatatactctgaactccaggaggctcatccaggtgagccccaggaggacaggggcatctcaatggaagggttatattcatcaacccaggaccagcaactctgcgcagcagaactccaggagaatgggagtgtgatgaaggaagatctgccttctccttcaagcttcaccattcagcacagtaaggccttctctaccaccaagtattcctgctattctgatgctgaaggtttggaagaaaaggagggagctcacatgaaccctgagatttacctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaaggtcagcaccatccctggcctcctcacataggaatctagcagaaatgatagacacagtccacctttcggccggccagcctgatctgggctcagcatgtttggggtcagtcagtgttggagagcccacatatgggattgccactagcttcttctgccaatatcaaaataccttctcagatgctttagaaacatgcaacaccaactccttttctaccctcctctccgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaaaaatttttaagctaatatttcactcttttgtcattctccttaagtttcatctcctaaaaagcttacccagcctgagcttggggacctgtgcagaggaaactaagaaaaatgcactcatcaactccttctcccagtgaacgcccggtgagaaaatccatttgccacaggcccttaccttcaacaatcccccttctatagtgttcgctggtaaagggtgaggctcccaagtgctggaaagcccctggacttggctcatttctcagcaagggcaggatagcacgggtcctttccatagaaatatcaacaaattctaacccaagcaatccctggacctacctgcctccagggatctctgaagaaaaaaagtaacccattgatcaaatcagaggagaggaagcaggaggtctcctagagcccattgaggaagaggaactttctcagtaggacactttataagcctgagaaagctttgaaaaggcggaatgagttgattcatttccacctcaaaaggaacctttccaggtccccctggaaattgtgccctggagatgtttaacaaggagaactggtgaggaaagagtccttttttactgtagggaaaagccccaaactggcctcctgggggatgagggctgaaatgatcccgaaggccttttaattagtgtgaaatcctgctgtactcagaaatccttccccgaatttacagcacaggcaggatgacctaagaggcagtttacttccctgagacccacagttgggctgttctggaaacacatctgtgaatcatagccaattgccacagagaaaacagaaccaagcctccggtgaggccactccaccccagagaagtctgcagaattccaaggactcggattggatgttcagaattcagcaactggaaagtccttaaaaacaaacaggccaaaccaaatcaatattgctgtttctagatgtcccttctgtggttgagctagttttacagagataaatatattaagacaaggaggtgggggtgttatatgatcaatgatagccatttgaaagagagggaggagtacagaaggaaggcacttctgggtacttaattcagaaatttctttatatttcagcactggattatcatataatgcaagtgactatggactaagagttagttatggtgtcttatgactagatttattatggtatattaaagtaacaataatattaatattaccttcctttttttttttgtttcaaaagagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggaaaacttaagcgaacaggacctgctgcacacagccccattgtcttctatccatttctctttatcattcaaatcaagcaacatgtgccctcctcatcaacacacattcttcccctttgtcagtatgcatctcccagcttagtgtcaggatactttcgattcataattatgtatgatccaaagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgattggtattgactgattcaaataaagttggtttattttcaaatattacaaaa

SEQ ID NO: 4290 - DNA, 569 bp, Homo sapiens
  ENST00000487396
atgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaagtttcatctcctaaaaagcttacccagcctgagcttggggacctgtgcagaggaaactaagaaaaatgcactcatcaactccttctcccagtgaacgcccgagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagca

SEQ ID NO: 4291 - DNA, 2390 bp, Homo sapiens
  ENST00000339561
cggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaaggtcagcaccatccctggcctcctcacataggaatctagcagaaatgatagacacagtccacctttcggccggccagcctgatctgggctcagcatgtttggggtcagtcagtgttggagagcccacatatgggattgccactagcttcttctgccaatatcaaaataccttctcagatgctttagaaacatgcaacaccaactccttttctaccctcctctccgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaaaaa

SEQ ID NO: 4292 - DNA, 609 bp, Homo sapiens
  ENST00000484572
tcagtgtctcttcctcttgtcctagctgcctgtggaaagaaaggcttcttcttccaacagatgagtattctgcagtgtgtggggagctggcagtgtgatgaaggggacaggattctagatgagctactccactctgaagaccctatgactgtatccactggcaagaagtttgaataaaggcccttttactctttcatgccagctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagacccaccttctcacttcctccagcaacttcctaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatcc

SEQ ID NO: 4293 - DNA, 869 bp, Homo sapiens
  ENST00000486570
caaagtcattgccctccatgaactaacaatctacagggagctgtaaaacaagtacatgtgcaattcccggcctgggtttgaatcccagcacttctagctgcacaactttacccaagaggcttattctttctgagcctctggctctgcatctgtaaaatggactttacattcagtttctttatctggcaataaggaaaaatccaaatggatttctcactttttgaccagatgtttcattgtcacacagcccgtgtgacagcactggcccctagtacaggcagagttgaaaagtgatgtgatgggtcatggttgcccctctactcagagaaaactccttcttgacctcatcacggtcgctgaaagtactaagaattatatctgaaatcaagcactggtagcagaacacaaatatgttaccaaattagttggaagaggttaggagcttgtaaggaagaccatagcagttgaaaacaaagcaaggcacatttccattgtacgtcccaggagtagtttgaatggtttaaggaccagctatgtgtgtgcttgcataagcgtatgtgccctgggtattctgcagtgtgtggggagctggcagtgtgatgaaggggacaggattctagatgagctactccactctgaagaccctatgactgtatccactggcaagaagtttgaataaaggcccttttactctttcatgccagctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgccca

SEQ ID NO: 4294 - DNA, 273 bp, Homo sapiens
  ENST00000476852
gcctctggctctgcatctgtaaaatggactttacattcagtttctttatctggcaataagaaaggctttatagctactcccagggatgcataaagcacggcaaaccaacaaaggccaagaggaggtgagaaagaaaaacaaggagacaaccatcaaatggagccctgggcccgaatcttcaaattgctcctgtcttctccttctaagaggtgccacctgcagtgggtcatgctcctggctgatgctgctagaaaaagaactcatctgtatcac

SEQ ID NO: 4295 - DNA, 499 bp, Homo sapiens
  ENST00000464137
cggcatgacagactcggcgacagctaacggggacgacagggaccccgagatcgagctctttgtgaaggaggaaggatggaggcgaggctgcggcggcgtttcccggtccgccggtgtaaggagaaagaaacatttgatcagcccttggtgccgacgctgcagaagtagggaaacctgaggctgcgggagagtagcctccagggctgagcagaaacagtcgccaggacttgggggaggggaagtcggggactgcctgggcgccaagacctttcacaaagggggaaaactctctcagtgcaaagtttccctagaaatatgcagatcgctgagaagggaagagtcactggtgcctgtcaggggcctcctggcagaatttaaaaggcataaatattccctggaattgggaaaatgttattttgcccaaaagatccttctctacaagctaattaaatagatgtttgcaaaaagtatgagatctacataaaccttgataacaatc

SEQ ID NO: 4296 - DNA, 2051 bp, Homo sapiens
  ENST00000544153
attttgggcgcgttggcggcggcgggatcgctgacagtcgcggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaaggaacaagtaccactgaaagggatgatataattccagctcagtcacactgtgtcagagtgatacaatgcaaagatcaggagacccgagttccggtcctgtatttgctgccaactagcagcatgagctgaggcacatcatttaatctttttggaattcatttttctcatgcctagaagaacagaagtggattgtattccttcttgccttcttttcctttcttctttccctccttctttccttttctcttgctcaaacatgtattcactaccactcaaaaaccatttgttgaacaaagcaaacaaatgaatctcccaagccttgggcttcatcctgtgatttcctcaattcccacctgccttaaattactcagtgaagccctgtccttggagaaaattcagtgggtggttaacccagagaagctggagatcaaaaagaagatggccaatgaaagaacaaaggccagcccttggcccctatctctttggatttctgctgatccagcttatcagatcccagaaacctggcaaacctctaaagttcacaaagagcgaaggggaagccaagtcaggcctccagtttggcttcggatgccaaaacttaatctgggctgtgggagctaactgttttcatatgaaagagcaaattcagaacatgagcatggaagtccctgcgaacgtcagatctccgtgtgcatccttacccccttgctgctttcatgctcactctcctcttgcgtggctcgctttcaggtttatctccatccctggaagcagagttgctctggcccaggctctccatgagagtttggcttgaacattcattgtctggccccctcctagttctcatctcccaaagtcaagccaatgtgtgaagaaatgaccagctcagcagccaaggcccagggtgcacaggtcttcgttgggagaggcatctgcaggcctttccttgctcactgggatccttgcctagcatagtgacgatgttcagccctggagacaaacaagaaggggaacaccaacatcaatagaagtatatatttacaaattgcatttctgctgtattgaaactaacattctgccctttaaaatcctgaaaataaaatttcagtatgaaatg

SEQ ID NO: 4297 - DNA, 3860 bp, Homo sapiens
  ENST00000360731
atggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaaacttactgcattaggctgttctcgcattgctataaagaaatacctgagagctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatggaaccaa

SEQ ID NO: 4298 - DNA, 3806 bp, Homo sapiens
  ENST00000349499
atggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatggaaccaa

SEQ ID NO: 4299 - DNA, 1888 bp, Homo sapiens
  ENST00000321356
gtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacataga

SEQ ID NO: 4300 - DNA, 3173 bp, Homo sapiens
  ENST00000461981
agattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattgtaagttcttggtatatcttcgttaatttgctggttttatccattccacatatcaaaatgtgcatcctaagtgtgtacaatttttatttgattaaaaataaagggggaggaagaataggtatgaagagatttgattacaggctgttgatccagcagtgtacatttcattcagcaagtaggatatccaccatataacaacgtactttgttgcagactatgatttagacttttctgatgcgcaaaaatagtaacttcgaatgctgggtaaaaattaaggcgtgatatatctcataaaagaaagcttcataagaggtagtaagttttagttactggtgattttctagcagactggaatgttgaccattctttgggaaaggaatcagaggttttttgttgggtttttttgttttttgaaatggagtctcgctttgttgttcaggctgaagtgcagtggcgcagtcttcactcactgcaaactctgcctccccagttcaagtgattctcctgcctcagcctcccgagtagctaggactacaggcacacgccaccacacccggccaatttttgtaattttggtagagacagggtttcaccatattggtcaggctggtctcgaactcctgacctcaggtgattacaggcgtgagccactgcacccggcctgttgtggggttttgtgatttggtttggtttggtgttttctgattacagcaactttctctttattctcagttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttga

SEQ ID NO: 4301 - DNA, 484 bp, Homo sapiens
  ENST00000464454
ggatattgacttatttttaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttg

SEQ ID NO: 4302 - DNA, 1682 bp, Homo sapiens
  ENST00000432425
tttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 4303 - DNA, 3208 bp, Homo sapiens
  ENST00000473565
gagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 4304 - DNA, 461 bp, Homo sapiens
  ENST00000472679
aggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatga

SEQ ID NO: 4305 - DNA, 1192 bp, Homo sapiens
  ENST00000409769
tacagtttgaagacagtaatacctggaattgagcatcatgtctgtcattcttaaatttgcatgcatctttctaacaggggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaa

SEQ ID NO: 4306 - DNA, 1664 bp, Homo sapiens
  ENST00000409403
ctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtga

SEQ ID NO: 4307 - DNA, 2026 bp, Homo sapiens
  ENST00000434813
aagacgcaggagggagcggactaggtgacagggccgttcctgtgagcctcgcgggcgcctggcgatgcccccttttcctgcttgtttgctgcccgccgtccccggcgcgacgactgcctgctcccttcactcccaggctgcacagtggcggcgcgcccctctttcctgcgcggccgagcctgtcgccgccggatccggcctgcgggggtagttacggtgtttgctaggccggccgccctcttggagcttctgccctccgctgaggaagcggcgccgcctgacgcgggacggtcgggcgggcgccatgttgtgaaccgcctcggcggagctgtaagatggcggctgggcggaggccggcttcggccctgtggccggaaaggcgaggctccccgttgaggggggatttgctggggttccagaatgtgcgtgagccaagcagctgtggggaaacgttgtctggaatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattg

SEQ ID NO: 4308 - DNA, 435 bp, Homo sapiens
  ENST00000461326
aaagcaggtaacatttctatcccatggctgccatttaaatctctagaaaagtgatctgggaaagcatagtaattgatacctttgctagctgttttaagttttcagtgttataaacatgaatggatattgacttatttttaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaattttta

SEQ ID NO: 4309 - DNA, 480 bp, Homo sapiens
  ENST00000496205
ctaattcatatttctttcataattgttttatttaaaacatctttcagtatataagcaattatccgtgtccatgtagggaatcattggcgagtttgttctgcaagccttaatgttagtttttttgctgtcagctttaactgtgtctgttttggtggtcatcttccccaagtctgtttttattttatttctagacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttct

SEQ ID NO: 4310 - DNA, 596 bp, Homo sapiens
  ENST00000492793
ttttgttgttggtgcgcgacgcagtcagctgcgtgattcccgtgattgcgttacaagctttgtctccttcgacttggagtctttgtccaggacgccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattatt

SEQ ID NO: 4311 - DNA, 690 bp, Homo sapiens
  ENST00000481641
gtgaaccgcctcggcggagctgtaagatggcggctgggcggaggccggcttcggccctgtggccggaaaggcgaggctccccgttgaggggggatttgctggggttccagaatgtgcgtgagccaagcagctgtggggaaacgttgtctggaatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattgg

SEQ ID NO: 4312 - DNA, 626 bp, Homo sapiens
  ENST00000482590
attttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgataggtaaggaggatacttaaaatgtctgaatataacaatacattactagacaaaactagtatcacttaaaataagtacctgattactaccattcgtttgtttccaatgagagattttgatggtttgtaatgtttgtaaaattaagctgcttgtgggggagtctaggtgctgtcttgaagagaatgtgaggatatttggtcttagcataaaacattgaaaataatttttatttctctagccattatttggaaagcaggtctataaatgagaaagattatcatagtcgacgctacattgatgagtacagaaatgactacactcaaggatgtgaacctggacatcgccaaagagaccatgaaagccggtatcagaa

SEQ ID NO: 4313 - DNA, 1843 bp, Homo sapiens
  ENST00000621181
gtgcatgacccgccccgcggcggagacgcgctcgctgcgtcatcagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacataga

SEQ ID NO: 4314 - DNA, 12747 bp, Homo sapiens
  ENST00000298912
gactccagctccgcggcgccctcgccgggtgcgtgccgctcgcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaccaggggcggggttacttcattttattttgggttctgggtggggcacttctacagacagttgaggacctccgaggaaacttagaccccctttctcgctattgtggtttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccaaaaagtttagaccaactatcgacatttgttttgttcttgtatttttcccatgaggaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatacacttatagtcccagctactcaggaggatgaggcaggagaattgtttgagcccatgactttgaggttactgtgagctatgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttggaaaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccaagtagctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgaataatttatacctgtgggaattaactggagtatttgttatttgactgttttctattaaggaatattaggcttggtgctatgatgaatgatcttgtaaaatcatgtgtattcttaagaaaatttttgaatataaatttcttgaactga

SEQ ID NO: 4315 - DNA, 515 bp, Homo sapiens
  ENST00000557215
ccttatcattaagcacagtccgatcggatatccggtttgggcaataagagatgtaaataaagtgaggattttaaagcccaaaggcctccttgctataaaaacgcacccaaaacgcctcacctggaccccgcgcgcacccagaaggatcacgttcagagacagaggtgcaacatgagtcaagagatttcatctttactaattgggttgcgggggcttttgtttataaatttcactgtaggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctga

SEQ ID NO: 4316 - DNA, 746 bp, Homo sapiens
  ENST00000557696
agaaagttcactatttgtagcaccaggaagtgttcaatcctcagatgacctagaagaagacagtagcgactacagcattccttccaggactagtcacagtgactccagcatttaccttcgacgacatactcataggtcttcggaatcggttagtatgtgaatttcttctctttccgcacggcccctgctaatcaattcctttccatccttcctcctccccagcccagagctttgaaattactggcatgcaacagctatacttttggatagaagacaagcagattggaaccttatcattaagcacagtccgatcggatatccggtttgggcaataagagatgtaaataaagtgaggattttaaagcccaaaggcctccttgctataaaaacgcacccaaaacgcctcacctggaccccgcgcgcacccagaaggatcacgttcagagacagaggtgcaacatgagtcaaggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctga

SEQ ID NO: 4317 - DNA, 3023 bp, Homo sapiens
  ENST00000556454
ggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggttagtatgtgaatttcttctctttccgcacggcccctgctaatcaattcctttccatccttcctcctccccagcccagagctttgaaattactggcatgcaacagctatacttttggatagaagacaagcagattggaaccttatcattaagcacagtccgatcggatatccggtttgggcaataagagatgtaaataaagtgaggattttaaagcccaaaggcctccttgctataaaaacgcacccaaaacgcctcacctggaccccgcgcgcacccagaaggatcacgttcagagacagaggtgcaacatgagtcaaggtccgatggacagtggcacgtgctcagtagcagatgtgttagaacccggagcagcacaccccaatccgggttccgggtggtggggtctctcgcactcacaagggaggggcttaggggaggaggtagaggaatgtatattgtttagcactttgattttggatctagacgctggcggtattgagaaatgcccggcatgctcggctttgtgtgtttaaaatcgttttatcttctgtttcagagatttcatctttactaattgggttgcgggggcttttgtttataaatttcactgtaggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccc

SEQ ID NO: 4318 - DNA, 452 bp, Homo sapiens
  ENST00000556441
taaaaacgcacccaaaacgcctcacctggaccccgcgcgcacccagaaggatcacgttcagagacagaggtgcaacatgagtcaaggatcattttagctatgttcagttgaggaacgcagcagatctggatgacagaagaaaccgaatattaaccaggtacagtactcagaagcttactgagctgattttacagttttatggcatcagagcagacatgaagagggaaagcaaacatgccaggatgtctatgaaagccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggacc

SEQ ID NO: 4319 - DNA, 1772 bp, Homo sapiens
  ENST00000556416
tcattttagctatgttcagttgaggaacgcagcagatctggatgacagaagaaaccgaatattaaccaggtacagtactcagaagcttactgagctgattttacagttttatggcatcagagcagacatgaagagggaaagcaaacatgccaggatgtctatgaaagtatttcttgctgtcggagaactgttggcctggcctaatgttgctgaattgctggaaacctgcccatttaaaacataggaaaccagaaaaacgtctcaaattcttacaattctgagacgtccccattcctgttgaagtcatagagttgctttattatgtttttatttttaaaaaattttatttactcgccacagatttgaattggcttggaaggatttagattactggaatcggaagcctctgtctgaatattacccaacacccaagagtgtggtcattagaaccccatccctctggctgctaaaaaagaagcaagacagctcctttcccctgccatgaaatggaaatactaattcaagttttccaccaggctggatatgctcataggaaaataatcctttttgctcttatgagatagaggcgttgaaaatagaacctgtaaagttgagaaatgcagtcgtgttttcagttgtctacattgagcatttattacctttataataaaaaatatggtttaggctgcgcatggtggctcacgcctgtaatcccagcactttgggaggccaaggagggaggactgcttgaggccaggagtttgagactagcctgggcaacacagagagaccgtgtctctataaaaagtatatagtttaacttgtttctgtggacagctttttaaagaagaccatcatgtgggtatttatcattcagtatgtagactgtggcagatgtttaatcccaccctgcccctcgctcctgctatcaggagatagttctgggacaagtggttttagcctctcgtaatctccattacaccgcacgaaaccaccctaagaggcttacactgcaggcttctctacatgcagctccaagcagaggccccagccccaggcaaaaccttctgggcttccctatgatccgccaggcaaaactgaaatgacattttaacactaccacctataaaataaaagcaggaaggtaaatctgactgaaatcaaatctagtaattattttaaaggtaatattccaaagccaaaacaaaactgtggggaatgggagaggtctttgtttctttctgatagatgatttaaaatgatctgctattagggacacttcatcccttagatgacctatggggtcccctgcgttactaacaaacagcagcaagcgatcagtatctaactccgtgtcactctctgagagcactgtggcatcaagaaaggtgtcccaggagacctggcctaggcgccctctctgtcgccaagttaattgcatggccttgggcaagtcactccaccccgaaagcctcagtgtgtccatctgcagaatggggctgccacctcctctcacctgatgttatggagatgaacggagtacgtgcaaaagctcgaggggctgcctggatggcccgacgcactgccttgggccagtacacacagtgtggggcctacctggacatggtgctggggagccttcgggtcttcaggcggggagtgggggccggggagagacgggtagcactgggtggggtccactttcctgggaacctgcttggtaactgcgtttcctctgtgtttcttctgtaggaaggccaacagctcaggag

SEQ ID NO: 4320 - DNA, 718 bp, Homo sapiens
  ENST00000555336
cccccttcctctctgtcttgtgtggtctcttgcccttttgccttccactatgggatgatgcaccagcagattccagtgctgtgttcttggactgcccagcctctagaaatccttctgttattgtgtgtcaaaatcacaagctccctgaagactaaggatgtgtctaagataacgtctccactcatagcaggcaatattttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaac

SEQ ID NO: 4321 - DNA, 685 bp, Homo sapiens
  ENST00000555615
tgtacacaagcgtggagctctctcttggagagctggctctctccaagagagagctggcctggcctgtgagtttaactctgatctaaaacaaaccaaacgtgttacctcccgattcaaagccaagggccttgggtgccgaaagcaggaggttgccccgggcaatggcctgtattgagttcccaggagtaccttgggcaagggccatgaagtggcacgtgattgctgacccgtaggggacagagacatcgcaatgccatgagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttc

SEQ ID NO: 4322 - DNA, 565 bp, Homo sapiens
  ENST00000553733
gtgcgtgccgctcgcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgagccctggtcaccagctgctgtgtccttggtgggcctccacggggagtctttgattctggagcccagccaagaacaggcctccacttccccatgagcgtggcctggcacttcacacctggtggagctgacccactggtttgccttgtaatgccatcttcccccaacctggaggagcgtcagtgtgcttcagttcaggctgcacgaatacaaatcctcgtcgcatcgtatttttcggttg

SEQ ID NO: 4323 - DNA, 5072 bp, Homo sapiens
  ENST00000448775
agctgaattttttttttccctctctctttcttcactcctttttctttccaaacagggaaaagtgttccacgaagcggtagcgccttttcgcctcgcgttttcctccctgaccctggtcccggctcccgtccgggcgccagctggtggggcgagcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcagctgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaatcaaggaaggataaaaggaagttcagtattgtaccacacttggaacttcctccatttcttccattttagaaggatatgaacctggaacttttgatgattctaagccttaaactatcaaaaagatcagggattgccaatgcttctaatggcactgcaagtatatgccataaccgttccctcctaaaagtgaaaaatgagagaaattcagtattttcccaggctcagcatccagaagtctagctctgggctggaagaaaagggtactaatatttagggaagagatgagaataagtagtgggtggcaggagagggctgagctagtgcctgctaacattttagttgtatcttggaaagatttagcaaaaataactcaccaggatagctgctgaagagttgatgaatgggagaagaaagatgtttgagaaataaagaaaacagcagcctgcaatacaataacttgcctttttaatagttttgattactcttgatacctacagcacaaatgctggacctgaatcagctcttcaaggaccctagcacaaatgtcaactgatcacctctgggagagtagaaaacttttttttttttgagacgaagtctcgctctgttgcccaggctggagtgcagtggcaccatctcagctcactgcagcgtccgcctcttgggttcaagtgattctcctgccttgtcctcctgagtcgctggtattacaggtgcctgccatcacacccagctaatttttggagttctgatagagacagggtttctccatgttggccaggcttgtctcaagctcctgacctcaagtgacctacccacccttggcctcccacagtgctggaagccactgcacctggctcagaatacttttttttttgagatgcagtcttgctctcatcacgcaggctggagtgcagtggcgtatctcggctcactgcgacctccacctcccgagttcaagcgattctccttcctcagtcccccaagtagcttggattataggtgtgcgccaccacgtacagctaatttttgtatttttagtagagatggggtttcgccatgttgaccaggctggtctcaaaacgcctgacctcaggtgatccacccacctcggccccacaaagtgctaggattacaggtgtgagccaccatgcccggcccagaatactttttaaaagaagagcaggttagaggaaagaaaaaaattgatgctgaatgtggtgatgaaagcatgtttctaaaatgggaagcagatgcttaaagaggaaagactaatctgggattttgccccatttctctggtttttcactcctatatttaattctcacaatcgtgtcgtcacatagtgcaaaaaacaaaattcttgtaaagtccccaggagtttatgcttgggtgaaagttttagcctgagtattttcttcctctaaaaaaggtgggaaatgagacattgaggaattaacatataaatgtctgctatgggtttaagagaactggcgtatttggaatgcttcttacactaacactgtctcattgtaaaatataaaaccccttactctaactacatttttattcctctggtagtgtggtatccaggcaacatatcacttctgctatgtaattctaagaattctcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatggaagtctacaacaaacacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatatagttttgcttccttctggtgttaagctgtttatatttcagtttcagttttaacttctaagttgccttgtaattgggactgtgtttcagcatcacaaaaaccaaatatttattatggatgcatctgtatcagcaattaaaaaataaacaagtaaaagtgatactgta

SEQ ID NO: 4324 - DNA, 585 bp, Homo sapiens
  ENST00000530371
agcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtgagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttcc

SEQ ID NO: 4325 - DNA, 712 bp, Homo sapiens
  ENST00000527977
ggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtaaaatagatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctc

SEQ ID NO: 4326 - DNA, 668 bp, Homo sapiens
  ENST00000529128
ttttcctcttccagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtgta

SEQ ID NO: 4327 - DNA, 14202 bp, Homo sapiens
  ENST00000458420
agtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaagtcaataagcacaagccatggatcgagacttcatatcatggagtcataactgagaacaatgacacagtcattttggacccaccactggtagccctggataaagatgcaccggttccttttgcaggggaaatctgtgcgttcaagatccatggccaggagctgccctttgaggctgtggtgctcaacaagacatcaggagagggccggctccgtgccaagagccccattgactgtgagttgcagaaggagtacacattcatcatccaggcctatgactgtggtgctgggccccacgagacagcctggaaaaagtcacacaaggccgtggtccatatacaggtgaaggatgtcaacgagtttgctcccaccttcaaagagccagcctacaaggctgttgtgacggagggcaagatctatgacagcattctgcaggtggaggccattgacgaggactgctccccacagtacagccagatctgcaactatgaaatcgtcaccacagatgtgccttttgccatcgacagaaatggcaacatcaggaacactgagaagctgagctatgacaaacaacaccagtatgagatcctggtgaccgcctacgactgtggacagaagcccgctgctcaggacaccctggtgcaggtggatgtgaagccagtttgcaagcctggctggcaagactggaccaagaggattgagtaccagcctggctccgggagcatgcccctgttccccagcatccacctggagacgtgcgatggagccgtgtcttccctccagatcgtcacagagctgcagactaattacattgggaagggttgtgaccgggagacctactctgagaaatcccttcaaaagttatgtggagcctcctctggcatcattgacctcttgccatcccctagcgctgccaccaactggactgcaggactgctggtggacagcagtgagatgatcttcaagtttgacggcaggcagggtgccaaagtccccgatgggattgtgcccaagaacctgaccgatcagttcaccatcaccatgtggatgaaacacggccccagccctggtgtgagagccgagaaggaaaccatcctctgcaactcagacaaaaccgaaatgaaccggcatcactatgccctgtatgtgcacaactgccgcctcgtctttctcttgcggaaggacttcgaccaggctgacacctttcgccccgcggagttccactggaagctggatcagatttgtgacaaagagtggcactactatgtcatcaatgtggagtttcctgtggtaaccttatacatggatggagcaacatatgaaccatacctggtgaccaacgactggcccattcatccatctcacatagccatgcaactcacagtcggcgcttgttggcaaggaggagaagtcaccaaaccacagtttgctcagttctttcatggaagcctggccagtctcaccatccgccctggcaaaatggaaagccagaaggtgatctcctgcctgcaggcctgcaaggaagggctggacattaattccttggaaagccttggccaaggaataaagtatcacttcaacccctcgcagtccatcctggtgatggaaggtgacgacattgggaacattaaccgtgctctccagaaagtctcctacatcaactccaggcagttcccaacggcgggtgtgcggcgcctcaaagtatcctccaaagtccagtgctttggggaagacgtatgcatcagtatccctgaggtagatgcctatgtgatggtcctccaggccatcgagccccggatcaccctccggggcacagaccacttctggagacctgctgcccagtttgaaagtgccaggggagtgaccctcttccctgatatcaagattgtgagcaccttcgccaaaaccgaagcccccggggacgtgaaaaccacagaccccaaatcagaagtcttagaggaaatgcttcataacttagatttctgtgacattttggtgatcggaggggacttggacccaaggcaggagtgcttggagctcaaccacagtgagctccaccaacgacacctggatgccactaattctactgcaggctactccatctacggtgtgggctccatgagccgctatgagcaggtgctacatcacatccgctaccgcaactggcgtccggcttcccttgaggcccggcgtttccggattaagtgctcagaactcaatgggcgctacactagcaatgagttcaacttggaggtcagcatccttcatgaagaccaagtctcagataaggagcatgtcaatcatctgattgtgcagcctcccttcctccagtctgtccatcatcctgagtcccggagtagcatccagcacagttcagtggtcccaagcattgccacagtggtcatcatcatctccgtgtgcatgcttgtgtttgtcgtggccatgggtgtgtaccgggtccggatcgcccaccagcacttcatccaggagactgaggctgccaaggaatctgagatggactgggacgattctgcgctgactatcacagtcaaccccatggagaaacatgaaggaccagggcatggggaagatgagactgagggagaagaggaggaagaagccgaggaagaaatgagctccagcagtggctctgacgacagcgaagaggaggaggaggaggaagggatgggcagaggcagacatgggcagaatggagccaggcaagcccagctggagtgggatgactccaccctcccctactagtgcccaggggtctgctgcctggcccacatgtcccttttgtaaaccctgacccagtgtatgcccatgtctatcatacctcacctctgatgtctgtgacatgtctgggaaggccttctccagcttcctggagcccaccctttaagccttgggcactccctgtgtttcatccatggggaagttccaagaagcccagcatggccatcagtgaggacttcagggtagactttgtcctgtagcctccacttctgccctaagttccccagcatcctgactacctgtctgcagagtttgcctttgttttttcctgcagggaagaaggcccacctttgtgtcactcacctccccaggctcagagtccccaaggccctggggttccaactcactgtgcgtctcctccacacagaccagtaggttctcctatgctgactccaggttgcttcatacaaggagggtggttgaacttcacacacgtaaggtcttagtgcttaacagtttaaaggaaagtccttgttgaggcagaactaagtttacagggaaaggtacacacattctctctctctctctctctctgtctatctagttccccagcttggagagcctttccccttgcttctttctgaggccatataagcttataagaaaagtcccaaaccaagaataggtccttggccacaagcagggtctgatcccccatcagagctatctgagcctgcctgtctgggcacctgctgcaaccatgcagctaccctgccaggggcactcagcaaacagaaccacagggcccaggaggcattccacacaggcactgccccaggacaacacaacaaggacagtcacaacaaggacaacaaggacacaacacaacacacaacaaggacagtcacaacaagcctagagccagaaagcagatggaaatgctaatgaggtcaaacgtaggcttcatggtgggtggagtgggggtggctgggctcccccaggacagaggggaccctgaggttggcaaggctctcaccactcagccttatggtcccttatctcctatcttccctcttgagaaaatacacgctttctgcatgtattagaaacgcacgagctccaccaagtctacaatgaaagtttgaaatttaactgcaaggaattagaagcatatttgcaatcattgcagcttcttctttcttctgctcataaaaggaggaacactttagatagagggcaaatatatctgaaaacctaatttctttctttttttgataaggaaatcttttccatctccatcctaacatgcacaacctgtgaagagaattgtttctatagtaactggtctgtgatcttttgtggccaagagaatagcaggcaagaattagggccttgacagaatttccacgaagctctgagaacatgtttgtttcgaatgtctgattcctctttgtcatcaatgtgtatgctctgtccccatccttcactcctcctcaagctcacaccaattggtttggcacaggcacagagctggtccctagttaagtggcatttatgttaaaaaaaaatagttcagaatctcagccttttctttgtgtcatcaaaacagcttaagaaggggactactgccaatgtcctctagtctgacctccacccagggaggacccatggcaggtcttttcaactttctgattcatgagaacaaccttgtgaagcttttcccacctcctaaagtgttttctgcatctgttccttcctttggacctcacaacaaatcctgtgaagtaactgagacatctgttgttagatacatttttgtgatgagtaaactgaggcttcgtgattcaatgtcttgttcagagtcattcaaaagtatagacaagaccagtctccccaacttccactcctggtgcaggattctacttatgttcataggtatgcacctaacagacactgctgcaaacctactatgtgctaagcatcctaccaatagctgtgagaaaaagaaaagctgaataagataagctccttccctacattatatttgcagacgggaaataaacaggcctagaaattacacaagagacaaatgaagaggaagagaagtcacaagagaagaaggatgcggtcacaaacttaaccagtgctcttatttttcccttctcagggaaaaacaccagaagaagctggggttttatattcattggatggaaacagatatttctcctgggaattctcccaaccaaatagcccttttctattaggctgtgtctgtacatccacaagaggaaagtctataggactgattagttttcacaatcccatttaaataaaaaaaagatctttagttgggcatttaggagcaactgaattctcccaaaattgtggcagcaaaaagaacacttcatatgcttaaaacccattctttttgaattagattttgattttaaatatttaagtctggtgtttgtgagaacacttttctctttgctcagtcttttcgatctggttgggtagggaaggtgttcctcatgctctctgggtggctgccttattcatagttgagagagctgttaggtaaaatctttatatgtgttggggtttttttggtagggggggtagcaggtaaaggtggcccatggctagggcagcaaagatgaataatttgaggaagcatttggttggtggactcatttgcagagaaacagtggtgacaacaaatcagagctgtttccctcaactctggctataagaggtcattctctgcatgtcagctacaaagatcaggcacttgaatgaatccgctgggttggcaggcattggtcatcttcgcaacaccctcttcctcaccatggatgagaacaagacgggagtggttatatcccagtaacagaagctttgggaggtatccaggtgagcagggtaatgtggcttgccctcccccagatattctgatcccaagaaaaaggtgtcattaatcagtctggcattttccaccctccatatgctggcatccaggaaccaaaacccctgaaggcctagacaccctatgacctctaactgagatgttggcagccaggcagatgcaggctcatgtccaggaggaactgctgactggtttggccacagcccagttcattgcttgtcttgccaagtggacaaccagattctgccttcctgagcttgaaaataggctacaactctcaggtgattcagatgacatggaggagaagttggaggagaagattgaaatgcttaaatcccagtgcagaatgagttgcttcagtggagtaaagcaaccggctagttggtagcctgccttaaaaaatactaaacatatatcatcatacatttgatcaaatgctgtaagcacagccaaggcccaaattcatctagataccaaaaatgtgatttcagtgaaatctcttttcattgccgctttcttttgttgttgtttgttttttgagccagagtcttgctgctctgtcacccaggctggagtgcagtggcacaatctcagctcactgcaacctccacctcccgggttcaagcgagtttcctgcctcagactcccgagtagctgggattacaggcatccaccaccatgcccagctaatttttgtatttttagtagagacagggcttcaccgtgttggccaggctggtctcaaactcctgatctcaggtgatctgcccaccttggcctccaaggtaatgagattataggagtgagccaccgcacccagccctcattaccactttcttgaatttactcaatcatcctatcaagcagggtttagaccaacatctttgcatttaataagggctctactttgtatacatggaccatccagtgagagagctgggggtggtgagaagcaatgtcccccattcctatatgtcaggtgtcagcaaactatctgtaaagaggcaaatagtaaatattttgggctttgtgagccatttggtacctgtcacagaatagtcagccctccatatctgaggtttccaaatccatggattcaaccaaccttgaatcaaaaatatttgggaaaaaatgtatagttgcaactgacctgaacatattctttttttcattattattccttgaacaatacagtttaacaggatttacatagcatttacactgtattaggtattataagtaacctagagatgatttgaagaacacaggaagttgtgcataggctatatgcaaatactatgcattttatataaaggaattgaacatctgtggattttggtgtccgaggggagttctggaaccaatcccctacagatactgagggatgactgtactcagctctcctattgtagcatgaaaacagacaatacgtacaacaaatgaatgtttcaatacaactttatctagtttccataaaacaatttaaaaacactaaaaaagcaggcagtttggatttatgtaattttcatatctttttttacccttttgatttacatttttaataatttaaaaatataaaaaccttcctcagcccacaggccatacgaaaattagcagccagctagatttggcccaaggccaaagtttggcaacccgtaccatacaccatggaagttagccttccacctcaggagaaagcaagctgctctcataagcctctcaccaactacccagtagtctttgcctccaaactgaacaacaggaaaaagtgccatagtttttaattaagctgttttaaaagtccatgttccgggggaaaacaaaaaagaaacaaacaaaacacttgttatttgctgaactgacaaactgacagatattccacgagagttgaaagccttggatcgaggtgattgcctggttactgagtgctaactccactgaggcaagtgttagccccccaaggctcagtgccttcccagcacagctcagcccataatgatctctgagcaggagtgttcattatctcagactgattttcatttcagccctactcttgccattgctctaaaaatgatcctaaagacttgtgactgtttgaatcaatagcaacatcatcagtagaaagcccgaccaagcacacttcgaaattagcaatcttcttggctctatggctcaatatcagcaagaagaaaaaaagacaactttttttttaatcatccccacatttaaattaaccaaatagtttttacaaaaaagtaggtaagtgggtttaattctttgaaagtatttgccagtgaaaagtagatgatttttaggtaagataacgtttaggcctctgggggatccccaaagccttctgcaatgtactctggcaggctatgaatggtacaggattctgcatctatatgagacatttattgaggctgacaagcaaaagcccttggcacaatttaattttcacataaccactttccattgtccagctgcaggcaaaagaaatgagcaatgaaagttttgaagtctaccccagtaccctcatttcctgtctttatttcctttactttatagatgtattctatacctgctatgtagataatgctctagttttccctttagtgccaactggaaaaggagagttggctttacaggggctgtggattaagagccaggcttcattccatcccagggagacaaaaagagacagaagaagttacctccagcagcaccccagaaagctgacagatattccctgtatgcaggtagtaaacagatgggagtctgtgtttgcagctatgttcagtgtaattcagcagaccttcactgggcacttgtgatgggtcaggccctgtgccagcaacaggggaagggaggatgaacaaggcatgtttccctgaccatgaggagctcttggcctgtgagctgttgggatgtccctttgtggtgttggaagctgtgcacgagcagtcaggactttggggacagaagtttagtgttagggaggcagggtaacttgctttgacagctacccaccctaagtcagatgacaggtgtaattctaggggccctgatatgcatcactgaggcagactgaggagctctccagggaagtaggcaatatttccctgaatattcctcaattccaatcaaggctgactcagttcacttatggatgaaagccagttaccctgcccactgggcagaaataacatggttgacagctgacattcagagaaaataagacagaagcagtccttaaatataaacagcagccaggtggacctggaaatttaggaagggtgatgcaggtagaggggccagcaggagccaagtctcaaaaggcacaagccagactgatgcaagggagccctcctgaggcccaacatcagagctgaagatctaaggagggcccacctccacgagacctgctgagggcttacatttggtgctgaggagcagtggttccctgggccagctgcatcacctgggaacatgtgagaagtgcatattcttgggccccaccccagacctactgaatgagaagctctggaggcaggcagtctgtgatttaatgagctttctgacacacactaaagtttgagaaccactgatgcagaggatgaggagatgacttgagctggcatcgggaagaactgactattaactaacaaggtaaaatcaatgactagtgcagtgagggtgccaaagcaaaccacccccagcccccatcctgggcctttttggctccagtttatactcactgaagcagtggtttcaaggaaccttggtcctagtccgcatccttcacctgcccttgggcatgagacaattcctgcctgcctgccccttctatcctagagagagagactgcccaggagaggctgccatgaggtcactcatccccaggaaggccacctgccaggtttctgtaagctgagcagcctcttcgagggccatattttgtggagaaacactgaaactgcagcagtgaccctggtcactaggagagctgctttctacacagcctgtatgctggtggagacacccagggcctggcagagtgtggagggggtcatttaaggacgttgccaggttgccgcagcactgctctgtttgtttgtaatgagactggggcatgcagcatcacaattcaaacactgaattgcttggggaatggatggccttccttggaagggcagtaactcattctggatgttactaaaagtagaaaacaaaaatccaaaaacaaacctacagcctcatttacaattagaatctgtctgggccttctgatttctaaagtctgtgaggctgccaggattcaccaattctcctttcccctgaggcccagcaactattgatttatagcttaaactctgtgaaggtccacagacctttgaaaggaacttgctggtactttgtcagtcgtgtacacctaactgactcctcctacgaggtacagtctcctcatacaaggggttttgagatggagagtcagagggccagggccctgggctttggggtggaaggacagaagagtagcagtctaggaaagggactagacatgtagcctaggaaaactagcaccatctgttgagttctgaagaacccagattctctcctgctcacagcctcagcagtcttttcagagtcctcctgaatggcccaaagacacccctgtttctggggaacagaagggagctggtacctctggaccattgaggcaacacctccccagaggcaggaccccgcccccatgagaacatgcagttgaatgatgtggtgcctggccaggaccttggaaaacgtggccatgtgagactagtatagatctccaactattgctgcctctgctgatatggccacctccttaaggtaagaagactaccgacttagctattgtggcaccacgggagcctagcactgcacctggcccatgacatgtgtgccacaaatgttgaattgaattgaatcccagagatcacttgacctcagtgaagggactgggtttgaagaattaagaccccccagtggagaaagcctcctccaacttccttctcggtttgtgagtcaaggtcctttgtaaaatcagatcgacgagggtggaagtgcagtgaacagaggacaacatttgtgatgcacgtgggagaaaacaggagtggggttgtttggggactaccccttcctagctatagtcagtaaatggagcccctaagcaaggagcaggggtagatgtgcctgggtgaggcctgcttgctccaccgtcgaggtcatgggcagcatcccaactgaggagagaaaaccctaatttgttaatgacccagccttgtgctgctctccagttcctttcatcagatttactgcagagcagattcatcaacatgaagttcaattcccagtagactaatgaaaagagggcaacagacttgagaagagccaaaatgcagacagtgtgtattaatcacagacaacagaaacgtgttagctttaatgtctgtttgcttttatcttgaaatgaaaatgcatctctgttacctggaccctttttactgcacatttcagaacagaaatgggacacccacacacgtattgagggtccttttccccggcaggaggagctaccagagaaatgagcccacattttgtgtgcagagagaatcaacccacaggtctcagctgcagactccagcacctctgcagagaaggcaggcaaagggatgaggaggtagcatctcctcttcagaaggattcataagggcctctgtgaggagggccttgcttgtgcctgtgggtcatggatgttaatataaaggctcatccacccttggtggcaaaagtgcatccatcctggccaatatagaacactcacatctggagcccacgcccacccacctccagctcctctacatggctgcaagagcatggctgatgtgtgggattcagaagaggtctgctcatgttcactagccaaactttaggtggtgtgatacagcaaaaagctttttttgtttttctgtttttgttttgtttttggcgtggaggagaaatttagacttgaaagtcagggctgatcactcaaaaagtaagataggagatattgagggaaaatgtgactcatagttggagaggaaacaggagagtgggtacaagtgacagcaccaggaacaaccccctcccccagatgccaaagcattgctctgtatctaaagatgcatccaagtttgcaaaaaattatgggtaaatctggccatgtgaccaaagaggcagtcaaatcaattgcttccaaagtcagagctgtttgaaggtgatcagctcttaattgaactagtcatgatgaatcaatccaactgactgcatccagtctgacctcggtggtttccataaagggttgttgatgtcctgagctggacagggtgggcaggaggttgaagaaaaccagttggtgagtatagaaaagaaattgcatgtagaagttgtttgttctcaaagaaatctgtaggtgttagagctgggtttgttatgttattgtcagggacattataatattggtaaggaggagagaatgatttggtaggggtattcgagaaatttgagtacaaaatataaattatcagagatgagtaggctatggacagctgattatatatatgtgtgtgtgtgtatatgtgtgcatatatgtgtacatatacacataccccaaagccatatacatatctataatacagaagtaagaataaagtcataagtaccagcatattttaaatccttagaagcactggttgggatgttacatgttttttcactgttgttgtttaccgttagctctcaaagcagtgggaatagtgcttggcacatagtaggagtttggtaaacatttggaaattgaagacccagcttatcactccttcatagagactcagtagtatgagtataccccaaattgaatgagccacagagaaatgcatccagccacactccctcttagctgaggagaagcctctgtgaatccacagattccatgcaatattcagccagccgcagacacaaggtctggctcccttgtcgtgagagtgaaggcatgctgcacacagtgggtttgcatgcacctagactgcatctgctgaacacccaacagctgtttctacaagctaaagttgtagcttctctctaccactgtctaaagctgtagcttgtctctactattgtctctacaccgttgcccaaacacttggtataatgctattgaatttttcacctccaggcatgattttgtaaccaatgtaaaggttctgggttcagccagtctaaaaagtctaataatttcttctctcagtccttcccttctcccttgtctggagctgccaccgccatttaaaagtgttggacgctgtttattcccagcttctcaacctcagtgtgtgtgggaaaggcctgaaagagagaggtatgttttctctcctccagagtctctgtggtgttgacacagcagagagaggagggggagcagcctcgtcttgcagaatcaccttcaatcactgctactgtctgggccattactgccagtctggccggtgtctcccacagtggatggctttgcctccagcggtggaccagtgtgtacctgacatgtatcagacttctgagctcttcaagctgcctcaaagaatgaatctttttagtctagaaaatgtgtttatttgataaatatactattgtgtatgagtgtgaaacaatgcagactttggagtatctcattagaaggactgtatgaatttatagaaaattgaatctaatttcagaagagcgcactgtcttctcagtcaacaaggttgcccagccacagagggtcagagaaaatgtcctttcccctccccactccttttcatagaatcctctctcaggcctaactgagctgtcatatccaattcagactgacacagagtgaggggcgctgagagtctctatgtatataaagatataggaagaaaataaggatcatcacaggaatctgttgggcttctccccatgactgtgatcttacccatgtttgaatcacaaactttaaatttataataattatgattcttgcagttttcaagtaatttgttaaatgcctattcaacacagacagatttttattttcagctgtggcttgtaaatgcctacaaactgattcatgttggtggtcgttatgacactttctgtgaattggtgaataaatatgattttagaatttcacagtaaa

SEQ ID NO: 4328 - DNA, 2405 bp, Homo sapiens
  ENST00000511524
tgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaagtcaataagcacaagccatggatcgagacttcatatcatggagtcataactgagaacaatgacacagtcattttggacccaccactggtagccctggataaagatgcaccggttccttttgcaggggaaatctgtgcgttcaagatccatggccaggagctgccctttgaggctgtggtgctcaacaagacatcaggagagggccggctccgtgccaagagccccattgactgtgagttgcagaaggagtacacattcatcatccaggcctatgactgtggtgctgggccccacgagacagcctggaaaaagtcacacaaggccgtggtccatatacaggtgaaggatgtcaacgagtttgctcccaccttcaaagagccagcctacaaggctgttgtgacggagggcaagatctatgacagcattctgcaggtggaggccattgacgaggactgctccccacagtacagccagatctgcaactatgaaatcgtcaccacagatgtgccttttgccatcgacagaaatggcaacatcaggaacactgagaagctgagctatgacaaacaacaccagtatgagatcctggtgaccgcctacgactgtggacagaagcccgctgctcaggacaccctggtgcaggtggatgtgaagccagtttgcaagcctggctggcaagactggaccaagaggattgagtaccagcctggctccgggagcatgcccctgttccccagcatccacctggagacgtgcgatggagccgtgtcttccctccagatcgtcacagagctgcagactaattacattgggaagggttgtgaccgggagacctactctgagaaatcccttcaaaagttatgtggagcctcctctggcatcattgacctcttgccatcccctagcgctgccaccaactggactgcaggactgctggtggacagcagtgagatgatcttcaagtttgacggcaggcagggtgccaaagtccccgatgggattgtgcccaagaacctgaccgatcagttcaccatcaccatgtggatgaaacacggccccagccctggtgtgagagccgagaaggaaaccatcctctgcaactcagacaaaaccgaaatgaaccggcatcactatgccctgtatgtgcacaactgccgcctcgtctttctcttgcggaaggacttcgaccaggctgacacctttcgccccgcggagttccactggaagctggatcagatttgtgacaaagagtggcactactatgtcatcaatgtggagtttcctgtggtaaccttatacatggatggagcaacatatgaaccatacctggtgaccaacgactggcccattcatccatctcacatagccatgcaactcacagtcggcgcttgttggcaaggaggagaagtcaccaaaccacagtttgctcagttctttcatggaagcctggccagtctcaccatccgccctggcaaaatggaaagccagaaggtgatctcctgcctgcaggcctgcaaggaagggctggacattaattccttggaaagccttggccaaggaataaagtatcacttcaacccctcgcagtccatcctggtgatggaaggtgacgacattgggaacattaaccgtgctctccagaaagtctcctacatcaactccaggcagttcccaacggcgggtgtgcggcgcctcaaagtatcctccaaagtccagtgagtggacgctggtcagcctggggccaactgaggcagcagttgggaaggtcccaactgaggtcccttgggaatgttccctcacaaaacaggagttgcctttcgtcagctgtcctcaacttctgctattcctctgaggatgcctcaaaggatctgtgttcttgttttcttcctaagcaagatgttctgttgttttaccaccttgaatccacctttctctatcttgtatcttatctaatgcctagaaggtactactttctataaattctcagagagctaggaatttgaagtgatctgggtgtgcgtttgaagtgttctgatttaagggcgcagtgcgtggtacacaggaagtccttgacaaatgtttattaaattgaattaagttaaccaaccc

SEQ ID NO: 4329 - DNA, 570 bp, Homo sapiens
  ENST00000541953
aattctctctcgaacctgccatcgtcccgggcttcagaatccactgggcttggttcatcatggtttaaggtgaaattcggggcgaaggaggcaggacaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgg

SEQ ID NO: 4330 - DNA, 4185 bp, Homo sapiens
  ENST00000266546
agttcctcggctcccccaaaattgcagccaggggaaggagccttgaaactctccagccccgacgccccagtctcattggctccctcccccgctgcagcacctggtccccccccctcccagtcacctgattggccggcggccccatcaatcgttgcccggctgtgctgacgtcatcctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgtgaggcatcgtcatgtcctggggcaggggcggggggttgggtgtggtgagggaggggacatatcctagggttttcaaataaaacaatcagaaaaaaaaaaaaa

SEQ ID NO: 4331 - DNA, 671 bp, Homo sapiens
  ENST00000541667
aaacgggaagccgctgcaagtccaccgcctcagctacccagattgggatctgcccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactgggga

SEQ ID NO: 4332 - DNA, 533 bp, Homo sapiens
  ENST00000545663
gcagcgccgtgcggggtgggggtgggaaggaggtgtcgaggctccctggcacctgacagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccaga

SEQ ID NO: 4333 - DNA, 533 bp, Homo sapiens
  ENST00000535452
actggcgcatgctaagggtgtgtggcagatccatctgcttcgcctccatcccatcctggggagaaagtatttgctgcagttcagcaattcggagcacccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtgga

SEQ ID NO: 4334 - DNA, 547 bp, Homo sapiens
  ENST00000534830
aggacgggagggagggcttgcgggcagagggctcagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacaccccttt

SEQ ID NO: 4335 - DNA, 570 bp, Homo sapiens
  ENST00000539982
accatcttgtggctttctcctcagcattcaggaaggggttatggtggtcatcaccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcat

SEQ ID NO: 4336 - DNA, 4296 bp, Homo sapiens
  ENST00000537408
gcattgattcctctgctccattcctgcccctctctgccccctccctctgtcctatatatcttcacttctctcctttctccccatcctgtgttctgggagagtggcctcaagttggggcttggctgggagaagtgcagagtgaagggatcaggactgaaatgagttgggaggaggataagcaatcaggatctcaggaaacttctagatctttttctagtttcaattctgcccttaatctatcccttccctttcccagggccttctcacagcccaccactgctccctgaagttccctgtctccattctctagcacgtgaaatcgctaaagaacattctccacttcctgaccatggttcccatggagatagtgatcccctcctcttcacccccagggcaggttgtttccatgggaactgtctaccctgctataggagaaggctatgacctcccgcagaccctctgactcctttagtagctgatttcttgtcctcaaccacccgcctcctgtaaggtgctcctatagggggtggaaaaggtgatggtgctggggtgtgagttgtctgggtcaacaagggttgttgtgggagtagaggccctgctcacaggtgcttcctctcctctccctggggtggggccagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgtgaggcatcgtcatgtcctggggcaggggcggggggttgggtgtggtgagggaggggacatatcctagggttttcaaataaaacaatcag

SEQ ID NO: 4337 - DNA, 583 bp, Homo sapiens
  ENST00000538933
atagggggtggaaaaggtgatggtgctggggtgtgagttgtctgggtcaacaagggttgttgtgggagtagaggccctgctcacaggtgcttcctctcctctccctggggtggggccagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaagtgaggaagtccttgtctcctgccccatgtgttgcagggtcctcctccctgctcccaagcccaccatcctctgtccgtgcggtcatcgaatatccacccccacccgctgctgttcctaggacttagggagccccatcccctgctg

SEQ ID NO: 4338 - DNA, 910 bp, Homo sapiens
  ENST00000540931
ttgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatggtgagcctcccctccaggcactagccagagggggaaactggcttcttgtcccgcctctgtcactgcccagtgtgtgactgtgaacaggtcacttcccctctcttcatttgtgaggtgcaagtgccaggtgtgatatgccttgattctgtgctttatccccaacatgacatgttggatcgtactgctgtcagagtgcaatgggatt

SEQ ID NO: 4339 - DNA, 566 bp, Homo sapiens
  ENST00000535668
attcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggctgaccacaaggaccagtgaggactaatttgagttttcacctccttctgtttctcttgcaagtcctggtggagtggctg

SEQ ID NO: 4340 - DNA, 546 bp, Homo sapiens
  ENST00000544584
ttaaaatcctctcttgagccaacagttgcagcctcttcattatttattctccaggctgaccacaaggaccagtgaggactaatttgagttttcacctccttctgtttctcttgcaagtcctggtggagtggctgagtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctg

SEQ ID NO: 4341 - DNA, 568 bp, Homo sapiens
  ENST00000541770
agctgtatctgtgtctggggcccaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactatt

SEQ ID NO: 4342 - DNA, 390 bp, Homo sapiens
  ENST00000542663
gaggtgcttcctcatctccaggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccagtacgtaagcctggtggggctgggcagggaggggcaggtggcaggtgagtgtgttgggacaggtatcctccccctccacctctggga

SEQ ID NO: 4343 - DNA, 2288 bp, Homo sapiens
  ENST00000331148
agctgagtgtgctggctgctggggagaggggcgctgcagcagggtgtgggtgtgagtgtgaggagctcctgggccatgcgcttccctacgctctgctctgtctgttgacacatgagtctcaggctgtaggtaatttgcggacggggctggaatgcgatgtgtgtatttttctaggggcttgcttgtgtgactgctggtctctgtgtgtgtttggggcacacatacatggaatagtccctcagcaacgggaccgcccagggaggagctgctgtgtatgcatggtgggcaggggtgtgcacccatgtggggagtagtgacccagctgcccgtaagggccctgggcctggaggtgcgtgtgtggggtctctgcctccacctgctgtccctggggctgcgggctttcctgcttttcttccttgtgcttcttcgagagctgtgtgtgtgtgtgcaggaggcaggcagggctgtgctcatggcggctcgctctgtggccctcacggcccacgtctgtagtgtctatgtcttccttcagggggttgcctggtctgcccagctggtggggagctgggtgatgctgcacatatggctctaccgtgccttgctggagacccccagacgcgttcctttactcccgcagtgtgagcaggcggccaggtggctggtgtgggccagcatgcaggctggcaaaggcctggctcgggtgtggggcgtggcaacctttgtgcagctgtgtgcccacacggtcttcctgagcatgtacctgtgcatgcacatctgctttgccgccatcagctctaaggtccgtgtgagagtgaacgcaccgttctgtgtctcagtgcccttgaaggtccatgcccctctgagcctgggcatcaaagtggggctgcagggccagaagcatgggagagccacgggggaggcaggtatgcctcagggggagatgttggggaagcaggaaccccagacgtcccggagccccaagcccaccaggagaagggaggtgtcacggagtgagctcagtccagtgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggaggtgagaggcctggggaagcggggttctgtagggtcaagactgtggagcacacacgtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgtgaggcatcgtcatgtcctggggcaggggcggggggttgggtgtggtgagggaggggacatatcctagggttttcaaataaaacaatcagaaaaaaaaaaaaa

SEQ ID NO: 4344 - DNA, 787 bp, Homo sapiens
  ENST00000535313
tgagagtgaacgcaccgttctgtgtctcagtgcccttgaaggtccatgcccctctgagcctgggcatcaaagtggggctgcagggccagaagcatgggagagccacgggggaggcaggtatgcctcagggggagatgttggggaagcaggaaccccagacgtcccggagccccaagcccaccaggagaagggaggtgtcacggagtgagctcagtccagtgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccc

SEQ ID NO: 4345 - DNA, 11485 bp, Homo sapiens
  ENST00000275162
acaaagggcgaagagaggggcgtggggaggctggaaagcatggttgccccgcctggcccggcgacgcccgctcagcagcctgctgaggagtggggacgaagagcagcctaaacttagggctcgggatatttcgatgccacccaaattgccgtcctaccccaacgaggcagggaaaggagcggagcgcgcgcgcgagctgagtgagtgcttacgtcgcagcgagatctgtgctgggataattagagaggagttgggctgagccgagtcctctttcagcagcagcagccggagccgccgccgcagcccggtggggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctaggagaggctgcgggctgcccgcggacgatgtggccgcggctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctgatgatctctctccgccctggagctcagcgctgaagagctaccttattattaatcagaatttccatcgccacccctggcaggcgtatccttcagcagggaccgcaggaacattcacagtgcaggggctgagatgtgcgtgggggttgtttttgttacatcttggaagagaagagaagaggacagtaccaagatcagaaacacccgtgctaggtggaattaggggtgatttgttaggaaagagaaaggacaagaagaggagtgcggagcccttcaggggttcacatctctttaaaggaaaggaaagagggagccaaagtagggtgttgtattttagggggcagaggaagaagtttacaccccccggcccccccagctttgctgggggaaagcaggagcaacagggcacttgattggacaccaagattattaatttcctgtaggggagaggaagcaggcagcaggaggtctgggggctggagtctggtggtggcaaggaccaggtttgctttgggacagtcaacaaggtcttctgagggaaagctcagagataggcagaacaatgactcatttgcaagccggtctctcccctgagaccctggagaaagctcgcctggagctcaatgaaaacccagacacgctgcaccaggacatccaggaggtgagggatatggtcatcaccaggccggacattggctttctgcgcacggatgatgccttcatcttacgcttcttgcgggctaggaagtttcatcactttgaggccttccgcctcctggcgcagtactttgagtaccggcagcagaacctggacatgttcaaaagctttaaggccaccgaccctggcatcaagcaggcactgaaggatggcttccctgggggcctggccaatctggaccactatggcaggaagattctagtcctttttgctgccaattgggatcagagcaggtacacactggtggatattttgcgtgccatcttactttctttagaagccatgattgaagatcctgagcttcaagtgaatgggtttgttttgatcatagactggagtaacttcactttcaagcaagcctctaaactcacaccaagtatgctgcgattagctattgaaggcctgcaggatagtttcccagcgcgatttggaggaattcattttgtcaatcaaccatggtatatccatgccctgtacaccgtgatccggcctttcctgaaggagaaaactcggaaaaggatatttttgcatggtaacaacctgaacagtctacaccaactaattcatcctgagatcctgccctctgagtttggaggaatgctgcctccttatgacatggggacatgggcaagaacactgctagaccatgaatatgacgatgacagcgagtacaatgtagactcctacagcatgcctgtgaaggaagtagagaaggaactctccccaaagtccatgaagagatctcaatcagtagtggatcctacagtactaaaacgcatggataaaaatgaggaagaaaacatgcaaccattgctttctctggactaataacttctctacatccccttcatggattagaaatggaaagtattggttttcagcaacagggacaacactgtagaggaattaccagctggaaaccgacttattcatgttaatgtagcataatatataacaaggcatcaggctttccttggcctgaaccatgggggccctgggctggatttttaaaatgtcaataatttattctgtaagtgccaagttgtttgtaaatataatgtaatcttcatgtcaagtttgtaaatttcagtagtaactcagtttggaaaaaggttggctcaaaagtccatgccagtgttatgaactataacaaaaagcagaaaagacacagtcaaagctaattaaatgtagccctctttcctatgaagccatatttcagctctcatagtgattgtttcattgtttttctctgaaactctgtcagtattcaaacatactcttaacgggcacacacaactaagtgattccaggaaattttatgattaatgtatttcctgtctagtgattttcatttcagagaaatgtgtcttagtaactatcattggccttgcattttggaggcaaggaatggcagatgagctggtaaactgaacacttgaactcttctatgttgtttaattcttggaatcttgtgaaaagatgtgtttcctcaattaagacgtagaaatgtaaaaaagagtggattctttttaaattgctgtcttcacaatgtgccctttattcaagaccctattatatttcttcctaatgtactctaagtacatttcccctccaaaactctttgactaagagaatgagaactcatgtgaacagtgttctgacagctaattttgaacataaaattttccacttacagatgaggggctaatttctaattgttgtgcactggttaaaaagtatatatatatatatattcacacatatatatttttactgagctctaataaatccttaatgtgacaggcttataaaataaatcatagatattcaatgatcttatggataattacatgagataactctggaaaactacttccactgaagttaatgaaaaggagaaatagtgaaactgactttcagtgtacctatttaaaggaattccaagttaatttataatgcaatcttacatatgtgccatcttatttgaactatatttttccttcaaagaagcaataggtctcaacatagtgtaggtagcatcaggtgacagaaagccaattttattttcaaatttaagttaattatcttcgtgatcctatttatccacaatttctttcagaaaagactgaaaaaacacattatattcaggagatataatgaaattattggaaggcatctatgacaacatgtaatcatttatacgtggatttagaaatttgcatatttaacattttatttcataaaatttatacaattacagcaaatcttaattttttaattttaaatttcaatgtgaaaaaatgatttttatcacccataataaattttgagattgagagtttaccattaaagtattcttttggaagaaaaatatctcagaaactcttggaaaccaacaaaaataaaggcatgtgtcagccttcatattttttggccaaaagctcccaaaatttgttataattctgcagccaaaaattgtaaaagcaagctgaatacaccaatgtacagtgtatcaatggactgcctcatgtgtgtaaaaatacattaattaacacaaatgaaagataccttaataatgccaacctccagtcaagtgcagaagaataatgactgtcaggcactctgctctccttgtgacttttacagagattggaatgcactggggacaacatgtctcagcagttcttacctttataagaattctaaccattgatattcttacattcttgcctacctgacatacattttgtagccatgggctttttagactatataaatcttaggcagtataatccattggaataaaatagaaacattgtaagtgcagagggcagtcaacttttcattctcatgagtttctcttgatgtgtaccatttattgccagttttcagaattctgccagtttcagatgtcaaccagcattggcagcttctttcccctatcgtaaagttagtgtcatatataaaaataactagaaaggcatattttatatgtatgcctatctaattataagtatcattcacactgtctcccagacccacatttggaaagtttgcattgcattactgctcatctttagatgagcaattgagagttggctagattgtgtaaaatattttaaaatgaatgaacaaattacaatgatgatgccttttgaaattaccatatctagttcattctgtgaataaactcattttctagtaatgtttgtgaaccttagtcaagggatattcattcaactttataaatttacccctcagcaccagctatctagcactgtttaggaatttttcccttcatgatattctgtgtcacatcctatgtctatgaataacctatacactatagttgtatgcctataagcactcctatactcttgtattttaattgcaatagtatacctccactctctctctctctctcatacacacacacacacacactcttacacacacactaacacactagactgtttgccctaatgaattttcctctgtacttcgagagctattttagttgtcttgtcacttgaaatttgcgggcttcaaagaattatcgcatttgacttggaatggtccagtagtccatttacttctttcaccctgcctgttccatcttctatttctgatattttttctttcttccagttatttcaggggcaggtgattccaaagctggtttaaaaataaataacttctcttatgttgtcagtgatgtttgcctgcatttttgactactatttaagagggaagagattatcatgaaaatatactctaagaaatatgaagaagtgcctctttgaaaatggaataaagcaacgttactggcatatggattttatttgtactctcttccaaaaagtaaatacgtaaatctatattatataggtgaaatatagatatcatttgaagaaggatatttaaggcctttatttgaacatactcatacagtattaagtctctgttgtgtaagttaaatacagtaactttagtacatgttaatgataaacgtggcactaggctaaaacgatatacgagtattaaacagagttttgcaagcaagtttttgaagtgggcatgcatgaattctttcatttcagtaatggtttgcataagtgtagacagagatatttcctaagttttttcatatagaatacttatttactttatagtaccaaaaattcatacattcataagcaggaaagccaaaaattcatacattaatacttagcttttttaatactgttaactaggtcatattgttaaacatgtgaagcgtctgtaatattcctgagggaaaagaggtccctctattgcatcaagaaattggagagttgttttagacattggggaatatgtttatgactcttcacataaagaaaccttcagagccatggagtatgtcttcagggacagggatcatttgcttctacaatgtaaaggtttatggacatatctctggtcctttaaagaagttacattaagaaagcttgctgagaggctgtacactcttctgttgttttatttaaaggtctgccttgtgtggttggtgaataatatctcagcttctttttttgtgtatatttattaatgattacatgaaaagttgccatcagccatgaggacacttcaaaaattttcaacacactaaataaaatgagcagagctctagcatgatatttgaactttcagatatggtatatgtacattttttacaacaataagctcataggcatatattccattgtagatctgctatataaatacatagcctgaaacatagtaatgcatttgaaatttgtgaggtcactgatcatacaagaagaggcagattataaaccaacatattggaacaaaagaagattggttaaatatgcaaggtgtgtaattatcttcagtaatgaaaaggatttgttttcttgtttttgtctttggttttagttgaaaaaatagcttcccatatgctactggaactatttgacattatttgctacatgaaaaaaggcaaataagtaaacatacaaaagaagcttggctttgtaacattattatattatgatctcaatggcttagagaatataatcttttttaagaattaaagattttattttataaatatttggaggttaacataggacatgaaaatagtgctgtggattctgttatgtactaactatgggaatgaattctccagtaccataggaaaatatataagataacaactttgtggattgaaacactcaaattagcctttttttcaaggaagcaggtgtacaaatgatgctattgaaataaaaaaatgtagaaatcacttaattataggagttaaatataatcaatgcactcatggtaaataatggaaattgttaaaatttagaagagttttgtcattatttgacttagatttaagtctcagtgcaaatatgtctgtccttgatatagtgcatttattctgtaagacttattttacctggtgaacgagatggacttaggtgaaaataaattttaaccacagttttaagggtcacccaatcctcaactactttaaaaaattgcaatgaattttaattcatttacttttaacagagatacaaagcactgtcttgtttctaatccaatttttcaatttttcagattttatatttgcttaaacaataaataaaactcagaaaaccaaatagtttttgttttcaaagctatccaggaaaaataaaagatgtctaacaggaaatcatacaagtccttgaagaatactgagtatattatttgctattttactcaaatgttattaatttttactactacaaactacttatttagtactacacggcatttactatttggccttttgaaggagttataaattccaaaacactataatataatttttggacaagtatacatttctgtttaaaagaaatgtatgcttttattttgtatattttatattttaaatgtatacatttattttgcacattgttaatgttaaatttggtagtcctggatctgctgcatctataaaatggagatttctttaaaaaatcgtctaaaaattagcaatatttttattttgagagaaattgtgcttagctatttaagttaagattcctcaagtttgtgatatttgtatgtgtggggatcaaagaggaaaatatatagtaatttgtttcatcaaaatgacgtattcaatattctataacttctagtcaaactttcaaatgaaagtttgaaagaagtaaactaatgttttaattacatatagcaaaggaatgatcagtaaataaaataactagggttttcacatttgcaatagaatgactggattaggcaagagattaaatttagaaatttgaattacagaaaagcattggtttaaataaatcctcaaaaaagtaatcccaggtcaaaatatgatgtgaaattaaaaaaaaaattcagcctgatttgagaaagaatgcttactcaataaatatgtatttgtgtcttctgtgagtttccctcatttatcctatctgtggatgaaaagtcatctaataaggtataagagactcaattacatttacctagaaccatctacaagtagacttcatgaatttctttggctcaaactcagaggattttctttacacaggattcttgaggttatcaagaatcgttattgctgctccctcctaaaggcaggccaggagaagccacatttccagcagtagtatcctcagtgggaatgaaccagaaaacaaagaaaaagccagagatattgtctccactctcgttacaaaaaagtgcgttccttcttcaggaggatcgagtagaaaatattttctactcgaagaggccatggggaagtgatggtcaaatctctgttgtgaagcaagtttccacacagaaacatcatcaaaaacacgtacctctgagcatcacttctttctctaaaaataaaaataaatatgctgttttcctcccttttttctaattggcatcataaaagtataagaagccacaaatgcattgttgccacttaagaaaaaaatcctatgttatacatatatgaacataattcacttagttgcatatgattgaaatatttgcatgctggtttataaattattacctaaaagttttatgaaatataattattaagttttagtgctagaaaaattgttgttttttgtgttttgtattcatagggaagactagtaatatcccttactcctcattcatatagctaacaattttaattggatggctaatggatatggcggatttaacatttacaaaaccaaactactttcactctgaccctgcttcccctttagccttctcatctcactatgtgtcgaccccaatcttccagtttctaggaataaaaattttggagtcatcctctctttccttcctctttttctttcaaaactacatcacatcagctagctcatgctgttgggtcttcaaaatatatccacactctaaccacttctccaatcttcttcactgtattggaccaagtcttcaacattttccatctggaatattttaataatctaaaaactagtcttcttgcttccagagtcaattttcaacacattagcaagagtgagtctcttaaaatgtaactcagaccattttgttctccaaaccctctgaaagagtaaaagccgatgtctttatatcagtgtatgagaagtcttgatatgaaggcagtaagcaccagtacagcaacatagcatggtttctgattgggctggcatttttgctggtactatgaaaaaatagttgttaaatactttaatttcttgcttctgaagttctctaccccgttcttgccttttcttagataatctcttaagaatctctcctttatttactgctgccaaactgtcatctttgctgttccaggaacttgctaagcatgcctctacctcaggactttcgcatttctgttccctttgcctctaatttcagatatccacgtggtttattccctcatcttcttcaggtatttgcttaaatgtcatcttctttgtgaggactctctttcctaattttagatgaaacagccctgtggttcttcatattctcctttcctgctgtatttcctctccatagcatttatcacctgatacaccatacagattatttatttactttgcatttccccccaatagcaatgtgaactccacaagggcaggaatttttgtctgtttactactgcattactggtgccttgtacagtccctggaacttaacaaatccaaaatgatttcatgaggatcctaatttgtttcagcaagttatgtaacggccaatagtatgaattgaaagagtttcttgttgtcttaatttaaaaaattttgttatttatcttcaaaggggaaattttaccctctcatgataatagaatcatgaatcaaaaatgatatcctcttctccccaattgtgatctctatccctgagcctaagttttacatcagtatttcagttttgtctttagaagttactcaacgatcactggaccctatatctatccacatggcttactcttggagagactacaagatagctcaggggaaaagtcattttgagattaaaactacatggaattgttctttatggattatcatggttaatttcaatttttaaaaatatgcaggaagttaaaagactataattccagtattggaagccagtttaagagaatatgactatgtagttacttttaatggaaaggggaagaagaggaagaaaaaggaaagacattgtgttcgtatcttctctgcaacaattataaaatgaatgaggaagtattttggtgtttctaaggtctttccatgatcttgaaatctatatattatagtcatttagtctgtgaaccattttaacaattgggtttcatgttacatatctttaaatttttatgttgaaaatttatagctgtgacacaagatgatagaaattgctcatgctcacatatattccaactggcttttcagcttgctcccttctcttttaatttcagctatcatttttagagccttacagtcacaattgttcttaactatcccaaatttttatttcctatttggactgacttctccataattttagtaactaaatgacctagatattggttcttgttgtgataggtttctgatttgtatcctttgcagtttaacttttaatccttaccaaacatatgttattccttttcttcagctacattgttgtgcctttcccaacactgtaataatttaagcctcctgttttataatcttctatcagaacatatattaagaagacactgaatttaaagaatcagcaggtgatgttgaagaagaaatataacctgaaatataagaatagatgtttgaaactgtttcagaagttaaccagtcttttagtggctttgtaatgggtaggggttttattcctctttgtgtgctatgtaggacattgttaaccaatatagattatgtttcttgtcagttacacaaggataggtaatcagggttaacagttcggaaaacattctctagagaagagactaatgattcttgctcacaaacaaggcagaatttccttatgtttcttaatatttgatccttgatagtctgtacagtggaaaccatttccctctgtgatatccttttttgccaacctatatgaatgtgtttagcgtcacttcagatatagagttcaagctcaagtatacacagcacatgaaagatcctatagttcatgttctcttaggttgaattttcttttcataattttttatgattgaattctaagggtatgttccttggtaaattgtgttaattatgtccactttataatggatttaacaattttacaaagcagatcattgtttattatattctgaaaaccattatattaatattttatttctttttttgcagagaaactattgtcttttttgatttctgaggatgaatgaagtactgttaaataaaatgtcactaaatgaaacttcaga

SEQ ID NO: 4346 - DNA, 1359 bp, Homo sapiens
  ENST00000368438
ggctgatggatgccagggagtgccgcattgcttagcgaccccgcctctgggtttgctggtacacactggtggatattttgcgtgccatcttactttctttagaagccatgattgaagatcctgagcttcaagtgaatgggtttgttttgatcatagactggagtaacttcactttcaagcaagcctctaaactcacaccaagtatgctgcgattagctattgaaggcctgcaggatagtttcccagcgcgatttggaggaattcattttgtcaatcaaccatggtatatccatgccctgtacaccgtgatccggcctttcctgaaggagaaaactcggaaaaggatatttttgcatggtaacaacctgaacagtctacaccaactaattcatcctgagatcctgccctctgagtttggaggaatgctgcctccttatgacatggggacatgggcaagaacactgctagaccatgaatatgacgatgacagcgagtacaatgtagactcctacagcatgcctgtgaaggaagtagagaaggaactctccccaaagtccatgaagagatctcaatcagtagtggatcctacagtactaaaacgcatggataaaaatgaggaagaaaacatgcaaccattgctttctctggactaataacttctctacatccccttcatggattagaaatggaaagtattggttttcagcaacagggacaacactgtagaggaattaccagctggaaaccgacttattcatgttaatgtagcataatatataacaaggcatcaggctttccttggcctgaaccatgggggccctgggctggatttttaaaatgtcaataatttattctgtaagtgccaagttgtttgtaaatataatgtaatcttcatgtcaagtttgtaaatttcagtagtaactcagtttggaaaaaggttggctcaaaagtccatgccagtgttatgaactataacaaaaagcagaaaagacacagtcaaagctaattaaatgtagccctctttcctatgaagccatatttcagctctcatagtgattgtttcattgtttttctctgaaactctgtcagtattcaaacatactcttaacgggcacacacaactaagtgattccaggaaattttatgattaatgtatttcctgtctagtgattttcatttcagagaaatgtgtcttagtaactatcattggccttgcattttggaggcaaggaatggcagatgagctggtaaactgaacacttgaactcttctatgttgtttaattcttggaatcttgtgaaaagatgtgtttcctcaattaagacgtagaaatgtaaaaaagagtggattctttttaaa

SEQ ID NO: 4347 - DNA, 947 bp, Homo sapiens
  ENST00000272425
agacggtatctcctggatgccagtgagcggctgagagctgaagctccctggacactcaaggctcttgtggtgacagtctgacgtaaaggcgtgcagggaggcctagctctgtctcctggacttagagatttcagacacagaagtctgtccatggctccttgtcacatccgcaaataccaggagagcgaccgccagtgggttgtgggcttgctctcccgggggatggccgagcatgccccagccaccttccggcaattgctgaagctgcctcgaaccctcatactcttacttggggggcccctcgccctactcctggtctctggatcctggcttctagccctcgtgttcagcatcagcctcttccctgccctgtggttccttgccaaaaaaccctggacggagtatgtggacatgacattgtgcacagacatgtctgacattaccaaatcctacctgagtgagcgtggctcctgcttctgggtggctgagtctgaagagaaggtggtgggcatggtaggagctctgcctgttgatgatcccaccttgagggagaagcggttgcagctgtttcatctctttgtggacagtgagcaccgtcgtcaggggatagcaaaagccctggtcaggactgtcctccagtttgcccgggaccagggctacagtgaagttatcctggacaccggcaccatccagctctctgctatggccctctaccagagcatgggcttcaagaagacgggccagtccttcttctgtgtgtgggccaggctagtggctcttcatacagttcatttcatctaccacctcccttcttctaaggtagggagtctgtgatctctttctgtgtgtattggtcagaatagaatccattcagctgtagcagcaagcaatccccaacctttcactgcaatgacctttcaatgcaataaaagcttattgtccattca

SEQ ID NO: 4348 - DNA, 1200 bp, Homo sapiens
  ENST00000359320
gttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 4349 - DNA, 1173 bp, Homo sapiens
  ENST00000339180
cagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctgctgcagggccacgggcaatcaggaggaccacatccgctagatctactctcccactcagcaaaggtccagccccagccctggcctggcttgacccccccgggctggcatactccagccgctgtcccctgggttccagccccagcgcctggcttctggtcctggttgctctggttcatctgcttccactccctgggtagcagtgacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 4350 - DNA, 725 bp, Homo sapiens
  ENST00000342473
agcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 4351 - DNA, 818 bp, Homo sapiens
  ENST00000397227
agcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 4352 - DNA, 1931 bp, Homo sapiens
  ENST00000553750
ctctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggtaacagctgcctcccaacctggtgcctccatctccctgacccccggctcctggccagccttatgccagcccccagctcacccttcagtagcctccttccccaagccctctggacacctctcctgcccgcagctgccccttcttcgtctcctactctgccttcttgctgcctctccacccggagacatttacagcaggtttcagttgcagcaggaaggactgcagttagacagggtgactttttgggacattgaggaagcttgagacatagggatgggacaggggcaatgacagcctctaacatggccacttctcagcacgtccaagaagtctaactatcaaaaagggcagacttcctgcaactgcactttatctgtggtctgctgcccagaaacatctcttctcaggaaaggatcttcccctggttacttagcaagaccacagtgtagagttaaggcctctgcacgtatgccaccctaggtcatcagagctaaaggggctcccagaaaccactgggcagcatctgccttctctcttggcatggaatcaaaggctctggtccttgtcagggggctttcaggcatctgggggtggggaaagcattatgaggcagggggctcctcttggtccctgtggagtcgggtctctgtgggcacaactccaggggctggcattcacactgtacctatgaattactgtgggatagtgctcctgggagccatatggcttggccagactgctggggttgctgggtgagcagagtgggaggccggagactgcccttgaccggcaaatgccctgcaacggtggctcctgacaccaggggatagggagatgtgccagagtccttcctcccctccaaggacaggtagtaggtgccagcctaggggagcttccaaggaggggaaggcaaagccctggcccctgcctgtgtccccttcttggcatgttccacatgctcggtcctgcaggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattct

SEQ ID NO: 4353 - DNA, 831 bp, Homo sapiens
  ENST00000555731
gagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctgtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 4354 - DNA, 378 bp, Homo sapiens
  ENST00000382809
atgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggtttttggcatcatcctggtttccatctttgcctatgatgccttcaagatctaccggactgagatggcacccggggccagccagggggaccagcagtga

SEQ ID NO: 4355 - DNA, 1764 bp, Homo sapiens
  ENST00000555487
tggaatcaaaggctctggtccttgtcagggggctttcaggcatctgggggtggggaaagcattatgaggcagggggctcctcttggtccctgtggagtcgggtctctgtgggcacaactccaggggctggcattcacactgtacctatgaattactgtgggatagtgctcctgggagccatatggcttggccagactgctggggttgctgggtgagcagagtgggaggccggagactgcccttgaccggcaaatgccctgcaacggtggctcctgacaccaggggatagggagatgtgccagagtccttcctcccctccaaggacaggtagtaggtgccagcctaggggagcttccaaggaggggaaggcaaagccctggcccctgcctgtgtccccttcttggcatgttccacatgctcggtcctgcaggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggtgaggaaccctgacccctagcccagtttggggcccttccctctcctctaaatgatgcattttcctttcctccccgagcttctttccatttccacaccacagctgggctttgtcccatgctatgccctgcactcaaaggtgtgctttgactcacactgatttcacagctgcagggccacgggcaatcaggaggaccacatccgctagatctactctcccactcagcaaaggtccagccccagccctggcctggcttgacccccccgggctggcatactccagccgctgtcccctgggttccagccccagcgcctggcttctggtcctggttgctctggttcatctgcttccactccctgggtagcagtgtgagcgctctgtctcttgaatgtgcttcatattgtgtgaggggtatcctatggaggggttcagaatccctcagggtcgggctgctggctagcctggaaaacttcagggtaacgccccctgccttctgaggtcctgttaaccctgcacccctggcccccaggacttcctgcgctgtgtcagtgccatcatcatcttcctggtggtctcctttgcagctgtgacctcccgggacggagctgccattgctgcttttgtgagttcagccctgcaggactccttagcccctcaagagctcaggctggtgcttgcacactttctgtatcagaagccacagccaggacttggggttctggcttgcacctcaccctataccttaacccaatggccctatagcctctgttttgccatccccactcccactcccacaggtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 4356 - DNA, 996 bp, Homo sapiens
  ENST00000458535
ggcctccaccgccttccccggctgcccggcagcctcccctcgctcgctctcctcttcctctagggccccagcgcagctcgggagcccgcgcaccgaggcgctaggggcaccgcgcactagagggacacccgccgcgcctggacagcccccggcgggcgcccccctcgcacctcctgccccgcgcgggccgcgctcccctcccccgcgcctgtgtccccagggcgcagggccgcgcgtccagccccagacccgccggggtccctggggacgcgccagcccggcagtggctcgacgatggaggagccgcagcgcgcccgctcgcacacagtcaccaccaccgccagctccttcgcagagaacttctccaccagcagcagcagcttcgcctacgaccgggagttcctccgcaccctgcccggcttcctcatcgtggccgagatcggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaa

SEQ ID NO: 4357 - DNA, 1174 bp, Homo sapiens
  ENST00000307526
ggcctccaccgccttccccggctgcccggcagcctcccctcgctcgctctcctcttcctctagggccccagcgcagctcgggagcccgcgcaccgaggcgctaggggcaccgcgcactagagggacacccgccgcgcctggacagcccccggcgggcgcccccctcgcacctcctgccccgcgcgggccgcgctcccctcccccgcgcctgtgtccccagggcgcagggccgcgcgtccagccccagacccgccggggtccctggggacgcgccagcccggcagtggctcgacgatggaggagccgcagcgcgcccgctcgcacacagtcaccaccaccgccagctccttcgcagagaacttctccaccagcagcagcagcttcgcctacgaccgggagttcctccgcaccctgcccggcttcctcatcgtggccgagatcgttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaagtaa

SEQ ID NO: 4358 - DNA, 2215 bp, Homo sapiens
  ENST00000358821
gcattgtctcttcctctgcagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttcaaaccttttagcatatctccaaccttgcaatttgattggcataatcactccagtttgctttctaggtcctcaagtgctcgtgacacataatcattccatccaatgatcgcctttgctttaccactctttccttttatcttattaataaaaatgttggtctccaccactgactacaa

SEQ ID NO: 4359 - DNA, 646 bp, Homo sapiens
  ENST00000585136
tgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaagga

SEQ ID NO: 4360 - DNA, 4111 bp, Homo sapiens
  ENST00000582365
gggactccctctgccacattttttggaggttgggaaagttgctagaggcttcagaactccagcctaatggatcccaaactcgggagaatgacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttcaaaccttttagcatatctccaaccttgcaatttgattggcataatcactccagtttgctttctaggtcctcaagtgctcgtgacacataatcattccatccaatgatcgcctttgctttaccactctttccttttatcttattaataaaaatgttggtctccaccactgactacaatgatttccccatggattcattttcagaggagttactaaggcatggtactatattaacctcttgcctccccttcatttattttttcccacttcttgaaaagttccgaagctgaaatgatcaatattcatacccatatgccatttgggagtccttgtgcaaagatgagtatttttttttttattccaagcttctttacctttcctgagatcgatgccaccttgtcagcttctctgcctcccgttccttcttcctgtcccatcagaaaaggcccactctctctctatccaacatctgtgcacaggttgcaccagagcagaatttatcctgatagaatttctctcaccccattgaagttttactcaatgacaacatctaaattgctcaaagcttttaatagcatcagttttagatagagaactaatcaaccctgacatcagtaacacacgctaaatttaaagccatcagctaatgctgcattcattaatcattttagttaaccatcatgtttggcttgattggatttgacggtgtaaacaacaaaaaaagacagtcatttttctacagttgagtgtatataaacaaaatcaatctttatgaatttattatttaaatcacattaatggagaatcatttaggggcttattaaaatttttttctattatgactccaaataaaaacaaagcagagggccaggcgcggtggctcatgcccataatcccagcactttcggaggccgaggtgggcggatcacctgaggtcgggagttcgagatcagcctggctaacatggtgaaaccctgtctctactgaatatacaaaattaactgggcatggtggtgcatgcctgtagtcccagctactcgggaggctgaggcaggagaatcgcttgaacccaggaggcggaagttgcagtgaactgggatcatgccactgcactccagcctgggcgacagagtgagactccgtctccaaaaaaaaaaaaaaaaaaaaaaaaagcagaacacatttgcgttcaacttttttccatcactctgttggttcttgagatgtcagtgtcagtttaaaaacgtgctgtaccacctttaaaaggactggagcaggcaggcagtgattcagttcaccttgactctagtcatagaagtggacccaactgagagctcaacctagttgtgggcatttgtgaaggattccagttagtgttttctttggaagcaggaggcttcaagccatcacatctccaattctatagaatatcaagtcatcgttaaagaacagcagcaggtgtttgatattttgtgctattaagtgtagtttgcgctcatctaattatgcagagtttcgtggtgtttctcgattttgttgaacctacctgatgcatttggcactgtagataaggactaacagtaagagagatttagagtcttcatgttagtccattaacataagtttattataaaatacactgtaagcatttctggctaatgtaccatcagatttaagaagttacccaacaatatgtattcgctgatcttcattcctgctgaatctgagaccagcagtgtctcaattattacgttgctgccaggagagaaggggaggagaatgaatagttatggaagttgtagaatctaggatattccaaccctggattgccagagttcagagtccatgtttttctgtcacccagggtcacgactggtctccccagctcttccctcctgtttttccacccaattctaagccctgtggtgatccagaccctaccctgacgtgggagtcagaaaggagtatcttccaagctccttgtactcaaagggataaaagaaagctactcagttgttattcagatatattaaccagccatatggaggcaaaaaagggagaaatttaaatatttgttttttaacattttaatgatgaaatatatgcacttggacaaaaatgatcacccagtaaagttgggcgtacattgtggcatgcccatcagggggactttgttgtattggaggagggcaatgtatctggctttgttagtagacgtagcgcattaaagcgtaactattgtgataagtttaggggttaggaatatcatttgagtttggtagatgcttttctggaaaacaatgaggctgggaatgtttctggctttatgttgtattcataaaaataaaatgtactggcttggaaa

SEQ ID NO: 4361 - DNA, 551 bp, Homo sapiens
  ENST00000584316
tgctgaccggggcgatgggtggctcacggacccctatgtgctgacggagggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggcccaggtgttttcagccacacctttgacaaggtgaacactaaagcagggcggactccagctgcgtgatcctggtgaccaactcctttctctgacagtcacttcttggatggagttgctgccaatgg

SEQ ID NO: 4362 - DNA, 1511 bp, Homo sapiens
  ENST00000584004
ttcaagttgagatttggtggggacacagccaaaccacatcaggcaacttgtgcaatttttttcttctgttgttacttaggatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttcaaaccttttagcatatctccaaccttgcaatttgattggcataatcactccagtttgctttctaggtcctcaagtgctcgtgacacataatcattccatccaatgatcgcctttgctttaccactctttccttttatcttattaataaaaatgttggtctccaccactgactacaa

SEQ ID NO: 4363 - DNA, 485 bp, Homo sapiens
  ENST00000578498
ttctgaatagcacagacatcaatggctcccctttccctgtgatggcgtttcaggcatgagccaccgcgcctggccgtataattttttttttgagacagagtctgactttatcacccaggctggagtgcagtgatgtgatcatgacttactgcagcctcaacttcctgggatcaatgatcctcccacctcagcttcccaagtagctgggaccacaggcatgtgccaccatgccctgctaatttttgtattttttgtagagacagggtctcgccacgttgcccaggctggttgggaattcctgggctcaagcgatccacttgctttgacctcccaaagtgctgggagtacagatgtgagccaccgcacccagcatgtattttaaatgttttataatgaacacatattacttttaaaatcaggataagacaaaactaaaaaaccttgtttatgtataaaaggcatagctgagaacgtgaacatgatgc

SEQ ID NO: 4364 - DNA, 3641 bp, Homo sapiens
  ENST00000582461
tcagcttcccaagtagctgggaccacaggcatgtgccaccatgccctgctaatttttgtattttttgtagagacagggtctcgccacgttgcccaggctggttgggaattcctgggctcaagcgatccacttgctttgacctcccaaagtgctgggagtacagatgtgagccaccgcacccagcatgtattttaaatgttttataatgaacacatattacttttaaaatcaggataagacaaaactaaaaaaccttgtttatgtataaaaggcatagctgagaacgtgaacatgatgcaggtaactcactccgacctcatttgttgcaggcccaggtgttttcagccacacctttgacaaggtgaacactaaagcagggcggactccagctgcgtgatcctggtgaccaactcctttctctgacagtcacttcttggatggagttgctgccaatggctttggccacggggacccagacagtcaagaggcctgctgcaaccctgaagagtcctcccacagtctggctccaggaccacaacattggcacactcctttctacctggctttgttttctgtgtgtgttttgtaggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggtatggccacagactgatggataagctggaagaggcatgaggctagtatatcatatttgccctctgtctaagtcattgtctggtgctaatctccgtatcttagaatccaaagcagatgtgaattcccaggcatatttttgacattcacagccacttccccgtgggctggatcaaccagtcctttttcaatggcgtctaattggcactggcttctggcacttaaccacaagcagttacccatttcccagccatgttttccaaagctgttcattaacctaaatcccacgtcagccttcagccagtgagctggacttcttaccttttcaaagaccaagaaaagtctgagatgattccagctccaagacctctaactgttcatttttccagacaaaaccaagagccttaggggctaatctgtaagtgaatacatcattgtctcagtggactaagtaaacacaaagctgaaaacattccttacaggcaaatttcgaattgttttgcttttctcttcttcctctttctgggcagcatgcttgcctgacaaggtgtttggtagctagggctggttcctggggaaggggccgagagggggaaaagcaagctgaaaagaagcggtagagtgaattattatgaagcaggcatcttcttgcagaccagctccaggatggccagaagaaagaaaactggcttaaacatctgaagagttatttgatgtcttctgaataagaaaatgctttcattacataagttattattgtaatttggggttagaaatttataattgaacccacgtttctgaaagggctcctttatctatggccataccacactgaacgtgcccgatctcgtttgaaagggcccctttgccatttgttaactgaaaactgcagatcttgggcaaagaggggcactcatcaatggggagcattggtagtgatgggtagtgaaggcatctgaggacagcagagagtttgtgtcctgaggaaaaagtccttgcgtgaggcacagctgagtaaggtgacagttaacgtgtcctgaatggtgtctcagagaggcagagggtggtaacacaagcaacccaggtccactgggttctaattaagcatcctttggataattttattttaatataggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtcagctgatgcctgtgcaatgtgcctctctcttcttcctttactgcacacacccgggtctacacgtgggtgagctcctgttcaatttatgtgagaatggaaaatcgtccagactgggagcttaaagaacagacattcattcctcacagttctggagcctggatgccctagatcaggtgccaggccatttggttcctggtgggtatgggctgtcttcctggccgtccctgcgatggtggggttaggtggttctggtgtctctctttttataagagcaccagacccattggattaggacccccattttaacctcatttaacctttattatctcctccaggccctgtctccaaatacagacacactggggggttaggggttcaacacaggactttgaggaaacacaaatatttagtgcataacaaaaaaggctattaggaatgtttgctttatgcgctactggcagatactacaagatctcctaagcatcccagactactgagaaacaagaaattgtttgaccctgatatccatatcagtgataagaaatcaaggaaaattcacttttggatttgagtctaggactgattctcatcttcttaataataataatgcaattttcacatggaacttactaagtgcttttcatactgggatctcagaagtatgttaaataatttaaatggaatttataacatcaaatcttcctgtctaaatgacagaatatttttcctccttcatttgaatggaaattgtaacaaaatttctctttgtttttcctcttcttaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttcaaaccttttagcatatctccaaccttgcaatttgattggcataatcactccagtttgctttctaggtcctcaagtgctcgtgacacataatcattccatccaatgatcgcctttgctttaccactctttccttttatcttattaataaaaatgttggtctcc

SEQ ID NO: 4365 - DNA, 876 bp, Homo sapiens
  ENST00000471578
cgccgctgggctgagccccggcagtggctgcggcggcggcggcggcgggcggcagcggaggcagctgccgcctctgtcctcggatccgctccgctctgctccctggtgtgttgattcttcccccagctgctgcctaatggagtccaggcgctcgcgtcacaggaaatgcctatactgccctcctcactcacttccggtggcaggccacatcatgctgaacaagagccgagaagtagaatcgccagtgtcaagccgtccacgttgtgggatgcccactgttcccccaggatcactcaagaccctgtgacttgtggtcactgatgagtggaccaagtgaagtgatcctcatggaacacctttcctgaagagatgatgatggggccatttgacatgggacacagcaggtgctggaagaagcacatatttttagtgacaaagactgtgactatgttgcctcctggttataaagcaaagccaaactggagagaccagtgccagagcctttattactaaaaggcacatgcaaagtgctgtaagatttcacaggatggagagaacatctgtggcagtggacagagtcgtgagtgaccacagaaggctttctggaggcaggacttgagggcctttgcctcagacatgcatacggcaggagtgtgagatctatggagtgggctcagctcatggagcaaggaggacggcaggggctccaatgatgatgtctgcgtaagaattcccatttaagatctttccaagcacaagagtcatggcccaatggcagagtgtcctatgcccacgaataaatcaaggatgaagaagacatttttggaaccagcatagtttctggtaggatctttgccactacttaaaaaaaaaaaa

SEQ ID NO: 4366 - DNA, 968 bp, Homo sapiens
  ENST00000483512
tcccgggggtcaggggagggaggccagcgggccggcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaaggccacatcatgctgaacaagagccgagaagtagaatcgccagtgtcaagccgtccacgttgtgggatgcccactgttcccccaggatcactcaagaccctgtgacttgtggtcactgatgagtggaccaagtgaagtccacaagatggctgctgtggctccaggcatcacgtccacatgcaaatccatccagaggcaggaactgggaataggcttggaggtggccaggacagcaagtgggctgtctgtataaacctcccctccacttgggaaggaaaatcaccccccaagtcgattttctgtccatcttattgatcagagagcgttataaattcacccattaaataatctggacaaggggagcgtgcatgttgtccttggtttagactggttatgatttatgccctgaaattggacatattgccaagcaagcgaaattgagattccatcagccaggaagaaggggtaaggatgatgaatattgggtaggcacatgataggggttgtcacaagttttaagatgctttcaattagtaaataactgtcaagattaccttttgttttcacctgcccagtctccattgtgcctccttcagaaacacacactgggttttctttgggtgtgaaggggcctctgtgtccatcattccagtgtgagcacatgatctgagcccggtcagtgaggtttaattt

SEQ ID NO: 4367 - DNA, 778 bp, Homo sapiens
  ENST00000498126
gggagggaggccagcgggccggcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaaggtgcgtttttgcaagactgcgcactcacacgaccattgagaggctcactttgcagtggccctcccaggccctccgtggttgggtgtccgtctttgtcagaaaagggccagcagggggcaccaaacccgcacgtttctgccgggagagggcgtctgggccacatcatgctgaacaagagccgagaagtagaatcgccagtgtcaagccgtccacgttgtgggatgcccactgttcccccaggatcactcaagaccctgtgacttgtggtcactgatgagtggaccaagtgaagtccacaagatggctgctgtggctccaggcatcacgtccacatgcaaatccatccagaggcaggaactgggaataggcttggaggtggccaggacagcaagtgggctgtctgtataaacctcccctccacttgggaaggaaaatcaccccccaagtcgattttctgtccatcttattgatcagagagcgttataaattcacccattaaataatctggacaaggg

SEQ ID NO: 4368 - DNA, 451 bp, Homo sapiens
  ENST00000496372
attcaatatagtggcatgaaggaggagacacagagctacttcatgggatctgtcttcttaacagtcatgcattatgcattgctgttgtttcaggccacatcatgctgaacaagagccgagaagtagaatcgccagtgtcaagccgtccacgttgtgggatgcccactgttcccccaggatcactcaagaccctgtgacttgtggtcactgatgagtggaccaagtgaagtccacaagatggctgctgtggctccaggcatcacgtccacatgcaaatccatccagaggcaggaactgggaataggcttggaggtggccaggacagcaagtgggctgtctgtataaacctcccctccacttgggaaggaaaatcaccccccaagtcgattttctgtccatcttattgatcagagagcgttataaattcacccattaaataatctggacaagg

SEQ ID NO: 4369 - DNA, 389 bp, Homo sapiens
  ENST00000470602
gtggaccaagtgaagtccacaagatggctgctgtggctccaggcatcacgtccacatgcaaatccatccagaggcaggaactgggaataggcttggaggtggccaggacagcaagtgggctgtctgtataaacctcccctccacttgggaaggaaaatcaccccccaagtcgattttctgtccatcttattgatcagagagcgttataaattcacccattaaataatctggacaaggggagcgtgcatgttgtccttggtttagactggttatgatttatgccctgaaattggacatattgccaagcaagcgaaattgagattccatcagccaggaagaaggggattgtggtgaggagcaaatgaatcaacgcatgagcaaaggatggt

SEQ ID NO: 4370 - DNA, 897 bp, Homo sapiens
  ENST00000498382
gttcagctttgttcttactttgtttgtgttacactggtatccagtgatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcagataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtg

SEQ ID NO: 4371 - DNA, 785 bp, Homo sapiens
  ENST00000478120
gctttgttcttactttgtttgtgttacactggtatccagtgatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcagtgatcctcatggaacacctttcctgaagagatgatgatggggccatttgacatgggacacagcaggtgctggaagaagcacatatttttagtgacaaagactgtgactatgttgcctcctggttataaagcaaagccaaactggagagaccagtgccagagcctttattactaaaagataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatcta

SEQ ID NO: 4372 - DNA, 747 bp, Homo sapiens
  ENST00000481095
gttacactggtatccagtgatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcagttgcctcctggttataaagcaaagccaaactggagagaccagtgccagagcctttattactaaaaggcacatgcaaagtgctgtaagatttcacaggatggagagaacatctgtggcagtggacagagtcgtgagtgaccacagaaggctttctggaggcaggacttgagataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactg

SEQ ID NO: 4373 - DNA, 846 bp, Homo sapiens
  ENST00000470788
cactggtatccagtgatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcaggattgtggtgaggagcaaatgaatcaacgcatgagcaaaggatggtcgcatctgtgaaaggaaattcaatctcgggaccccaaaatcctacaccaaagagaaaagtcaagctgggaactgcatcaggcaaacctgcctcccatttaattgctaaataagatagctacaaagattttttaaaaaggaaaaaaaaactacatatctccatcacaatttgcccgcaaggaaatttttatgggcctcaagatctttaccctgaaacggttctgttgaatttcactttggaaatgtaagttgatagctgatcttcacaactgcgggacaaaggacagaactcaaagtcatccctctgctcacctgagacaaatgcatatctgattgctttctctgccttactgtttatgcaaaactgcagatgcactgaggctaagtgatcattcctctacccacccctcacatgtaaatcgtgtattcagtgaaaggctgataaaagactggaaagactgcaaccatttgtctcttacctacctgtgatctggaagcccccgcccccgtgctttgagttgtcctgcctttccagaccaaaccaatgtacgtcttacacatattgattgatgtctcatgtctccctaaatgcataaaatcaa

SEQ ID NO: 4374 - DNA, 866 bp, Homo sapiens
  ENST00000489556
actggtatccagtgatccattggcacagagacacagtttctactttgatacaatctgtgtcagcctggcagttaatttatttagcagcatcttaaatttttttgtttttgcataaaatccagctcctgcaggatatttatcagcatctttgcaagagaggatgaattcaaaataaagtacaagagaagaaacattcagtgatcctcatggaacacctttcctgaagagatgatgatggggccatttgacatgggacacagcaggtgctggaagaagcacatatttttagtgacaaagactgtgactatgttgcctcctggttataaagcaaagccaaactggagagaccagtgccagagcctttattactaaaaggcacatgcaaagtgctgtaagatttcacaggatggagagaacatctgtggcagtggacagagtcgtgagtgaccacagaaggctttctggaggcaggacttgaggcctgagtgagaatgcaggtgcgctgaaggagcaggcaatagtgaagagtcaaggtttgggaggggaaccagagaccccagacttcagaactgcagcttttggggtcaacacaacatcccagaacatcaagacaccaagacatatcagctaggaccctgcagtaggacatcggtgtccagatgagaccagaagcaacccagtagaagccaggggacagtgtgtggaccacagaattcatgcttgatgccatcaagggcctttgcctcagacatgcatacggcaggagtgtgagatctatggagtgggctcagctcatggagcaaggaggacggcaggggctccaatgatgatgtctgcgtaagaattcccatttaagatctttccaa

SEQ ID NO: 4375 - DNA, 612 bp, Homo sapiens
  ENST00000496277
catcttaaatttttttgtttttgcataaaatccagctcctgcaggatatttatcagcatctttgcaagagaggatgaattcaaaataaagtacaagagaagaaacattcagtgatcctcatggaacacctttcctgaagagatgatgatggggccatttgacatgggacacagcaggtgctggaagaagcacatatttttagtgacaaagactgtgactatgttgcctcctggttataaagcaaagccaaactggagagaccagtgccagagcctttattactaaaagtagaagttgatacacatttgaagttgcccatcccactaccaccaaatgatgtggaagagaatgagtcccctgtgacctagtgacgagaatgaagtaaatcctgtctcaaaagaagaaaatccacttccaagggacaaggtctcactctgtcgcccaagctggagcacagtggcacaataatagttcactgcagccttgaagtcctgggctcaagtgattctcctgcctcagcctcttgagtagctaggactacagataattgcctttgatgagttaaggacagattttaagagccccatagaccagtgcaatcctgttcatgcg

SEQ ID NO: 4376 - DNA, 823 bp, Homo sapiens
  ENST00000492470
tagatgagctgtatgagtcaggagttctgctctccaggtctgaggctgttcattgcctgggtttgtccagcgggcctgaagccatggagagcataatatttagaggtggcgaacccgacaccaccctgcttgcattctttgctccaggccttctgacctagttgtccttttcctgtaccccatgcttgctccctgagccctacgcttgctgttctccagattgaggctttctcctcttgcttcatactcccctccctcagcccactatgcactatgtcaggccaactggtcttactctgcaggagagtctgagattcactgttgcttcctgtggggaggcttttctgagcccccaggcctggtgctgtgtgctcccgtggcagcccctgcttctcctgtacaccacatattgccaacttgcttctgactttcccctactgagctacattctccatgagttgcctcctggttataaagcaaagccaaactggagagaccagtgccagagcctttattactaaaaggcacatgcaaagtgctgtaagatttcacaggatggagagaacatctgtggcagtggacagagtcgtgagtgaccacagaaggctttctggaggcaggacttgagggcctttgcctcagacatgcatacggcaggagtgtgagatctatggagtgggctcagctcatggagcaaggaggacggcaggggctccaatgatgatgtctgcgtaagaattcccatttaagatctttccaagcacaagagtcatggcccaatggcagagtgtcctatgcccacgaataaatcaaggatgaagaa

SEQ ID NO: 4377 - DNA, 525 bp, Homo sapiens
  ENST00000479227
gcctgtgggattcacaatttacacaggcctgagtgagaatgcaggtgcgctgaaggagcaggcaatagtgaagagtcaaggtttgggaggggaaccagagaccccagacttcagaactgcagcttttggggtcaacacaacatcccagaacatcaagacaccaagacatatcagctaggaccctgcagtaggacatcggtgtccagatgagaccagaagcaacccagtagaagccaggggacagtgtgtggaccacagaattcatgcttgatgccatcaagggcctttgcctcagacatgcatacggcaggagtgtgagatctatggagtgggctcagctcatggagcaaggaggacggcaggggctccaatgatgatgtctgcgtaagaattcccatttaagatctttccaagcacaagagtcatggcccaatggcagagtgtcctatgcccacgaataaatcaaggatgaagaagacatttttggaaccagcatagtttctggtaggatctttgccactactt

SEQ ID NO: 4378 - DNA, 2558 bp, Homo sapiens
  ENST00000272133
ccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagcggaggctggaaggccacaaggtgcttgctaaggaacagaatgacccagagtcaaggccaagtctgcagggacctgttgaaagcctcgagaatgtcttggctgcccaagactcttgttgcctttcttccaagccatggccatgccctttttctcaaatgggaggggctggagggtgtgtgggatttgtcttcagctgcaaccagccttgagcctgctgggctattttcagctgaggaggggtgaatataggaaaaatgcatttttgaaacgtttgcaacatgatcaaggtgttagttctccaccacacaagttgtattcttcttttgccacctcaaaccatcacagagtctttaaatgcaaatcaattggtcaatgctagtcaaagctatgttcttacaaaaaccccagacagctcagagctcagaaaatcctgtggagtggctgctctgtaccgtgggcatccggcagccaggaagtgagacaacataattataactttgttttatgatgctgcatcatttgtactgtttaggtcgacgtgaggacatcatcttatttagaattttccgtttggcattctcttttgggtgggagttatgctgggggttgtaaataatgacaaggctgagatttttatgatgtttaaattgggcacaatgattttgaccttattccccaaacttcttttcttttctactgtttaacatacacaggctatttatacacgtccccagctcccatctgaaacctgtgactcaggtttatgaatggtgtttgtgtagcaacacattgtgtgctatgtttattaaaatgcagcgacaa

SEQ ID NO: 4379 - DNA, 21063 bp, Homo sapiens
  ENST00000607772
aactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggattggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactcttagtcacctgtaattgaaatatttctgttttgcgtcatacacgaagctagtgaaaaagaaagtgcaaggcattttcagatgagcaagtgactatcgtggctgttgccagcagggcagtattgttaaaaaaaatcaaaataaaccctcccaagcattttgggattttatggattagaaatggaagaacaggagaagcatatgcaaagtgaaattgcacgaggggaattttctgaggtatcttcctaggcagagccgaaatctcctactccaaaatgccctttctcataccaccggaattgttgagtttgctgaactgcctggaattcagcccatgaaaatcactggagttaggaaacatcttccctttaaaatgcttctggtgtggttaaaggaactagcaaccactcatgtataattactgtgactgaattcagtcaggctggttttttttgtttgtttgtttgtttttgagatggagtctcaatctgtcacccaggctggagtgcagtggcgcaatctcagctcactgcaacctccaccttccaggttcaagcgattctcctgcctcagcctcccatgtagctgggattataggtgcccgccaccatgcctggctaatttttgtatttttagtggagacggggtttcactacgttggccaggctggtctcaaactcccaacctcaactgatctgccggcctcagcctcccaaagtgctgggattacaggcatgagccaccacacccggctcagtctggctgttttcttctctacctctaagacaactgccatgaagatctggtatttcggcctggcgcagtggctcatgcctgtaattccagaactttggggggccaaggtgggtggattacctggggtcaggagttcaagaccagcctggccaacatggtgaaaccctgtctctactaaaaatcagcttcgcatggtggtgggcacctgtagtcccagctactcgggaggctgaggcaggagaatcacttgaaccctggaggcggaggttgtagtgagccaagatcaggccactgcactccagcctgggtgacagaaggagactctgtctcaaaaaaaaaacaaaaagaaaaagatctggtatttcatggagacatggagacccaagggtgtttggcagatggagagaagaggcttgcagtgtgtgaccacagggtgttcaacacactaggagggtggggtgtgggctggggaggtctcgtgtagggcactggtgatgaggagggagctgtgtacgaggggcgagccagccctgcctgttttactcttgtcttgagctggctttatgcccaggaagtgggtggcaacatctcctcttactccccagattgtggggagaactctaagagctgtagttccactggatgatgagttaaatcactctggaggccttagctggctggtgagctctttttctgtggggaaaatgccacttgtgaattgaacagccatcctttaagtgaatattcggcagtcagtcttcattataggcagtggccaaccagattggtgcttttcagcctttgttccctggagtcccaggacccgcgagagaagttcctggctcctctacttgcagtcaccctccacagcttcatctttctttttatttgaggttttctcctgaattgtgtttgaaaaatatattgctgctaaaaaaaaaaaacctttgtaaacctctactatggacatacataaataatagtttaatatggatttcttagaaattaatggaaactgcttgcctcagtagtaatccaggtttaattgtggacgtgtgttcacatatgaagttgcttgatgatgctttttgacaggattctttatttttatttctttaaaaaaaatttttttttttttctgagacagattctcactctgtcacccaggctagagtgcagtggtacaatctcaactcactgcagcctctgcctcccaggttcaggcaattctcctgcctcagcctcccaagtagctgggattacaggtgcccgccaccacacctggctaatttttgtatttttagtagagatggagtttcaccatgttggccaggctgatcttgaactccttgacaggatactttacaagagtgattgttaaaactctcccagacacaactcaacacctacccctattataatattttatagcatcacttttcaatcttcaaatgaaaatcatggatgatgaagcttaccttcactcataaaaacatcactccatttactattctgaaatgaaactagcaggtaatataactagcctctaaaacatacccatcagtgacgttctaactgaaacagataagatattttataatgaaataattattttcatatgtacatattctagcatggttatattacaagatgtaattaaactactaagcagggcacatactttgtatgtgtgtgtataaatataaatatgtgaaaaatcaccatgaatgtggtagttaccaattcagacctgctgcattggcagttcaataccaggaaaggggtcgatgtcagcagtatgattttctaaaatgtggccaattctttagataaagttctaggcatacctagtctgtaatggcttcactcatatagtgcttgctgtgtgcctggcattgttctaatacctttctaataaatctatgaggtgagtactgctgttagtcccgttttgcatatgagggagttacccaggttatgtgctagtcatcctggttatgtgctaataatggcagagctgggattaaaatgaaagcagcctggctctggctttcttgctcataatcactcagtatataggcttccttccatttatagaattctctcattgcattcttgaaaaatccaaagcatattaaaactgggctgaaaattctgtgtgtttatatataaaatgaaatgagatcatagatttgttattgtaaactgagttcccatctatatgaatattgggcggggcaattgaaagttgtgttgatgagtcagctctttgttgtgagggctgtaagctgcagggcttgtgtatcacgcatgctccaacaggttaaatctcagtagtggccgcccatcagtggcacccctaacatgctcacatttccagaactgcctcttgggcggaggtgggggagggtaccatctctttcagaacaagtattttaaaagaaatcctgtatcctccttaagtagtatttcagtctatatatttgtccatttcctatctctgcttctctctcagttctttccccaccaaacctgaaatttcagaatctattttgtgggctttctttttttaattttttccctggaagaccatgaacattcctctttaggttgttagtattgcagcaaaccctgaggtattgacacaaaacttttcatccgccaaagagctcgagtaagtaaatctgtctgacatttgaatgtcaccagcaaagcatgagactcatgctgccttttgccaccataggcatgaatggtatggagaagtaggcctgacttgttttcttctattgtagatgagattagttttgtagaccattagttcacattttgctcctacccttgtgcataaaatcactgcatcatttccgtggggatgagactactgcaagctacttccttggagattctgtggaagatggacatcttaaaagtaaactacttttggtatgactgctcattggcttggccagtgatacttgatgttatttattttgtgagttactctgtgtcttaatcagctcaggctgcaataacaaaataccatacactgggtagcttaaatgacagaaatttctcaccgttctggaggctgggaagtccaagatcaaggtgagttcctggtgagcacccttaccctggtttgctgatagccatcatcttcccattgcatccttacatggcagagagagagaaaggaagcaagcaagctctcctttcccttcttgtgagggcgctaatattcatgagggctccaccctcaggacctactcacttcccaaaggcccacttatggtattagctccgcctcctaataccattgctttggagattagggtttcaacagatgaattttgggaggacataaacatgcaatccatagcactctgcttttgtatatttttcaaacctttcatgctaatcagctggaaggtgaatattttaaaatctattttaaaactggcttaaggagcacacaaaagctgatttctgatgtttcttccaatacgtggaaaattttgcatgatgtattaacccctagttagggtccctcaaccccagttgaggacctcaacacacatttggtaatacctaagggaatttaaatatatattttgtagcctatagcatatggaattagaaaaaaattagtctctttactgtaaaatttaccttttaattatttggaaatttcacaattgccaagtttcaacttaaagtttctatttatttggggccagaattattgccagaagtgtgctaatttgacaaagggtaccttttacataagtaaaggaaaaagtgattacatcatgttcagacctgctagagggccttgtttttcctctagttttaggggtgtggagtctgtcccaaaccctatatatgtgtgcatttgtgtatgtaaaagacaaattttttatactcaaaagtttgtcttaaataatggcctatggcctactgatttggatagaggagagaaattttgtctataagcaacaaaaaatgctacacagccaggagactgtcacacacagtttttcagaacctttgggccacatactgcactccccttccatagaaatacacatggggtcagtgattaaggactcaattctggttgtgacttggccatccataggcatattctaaagttctatggcaacctttatgaagctcgtcttctgagttgatcacctgttcatgcgctgcccatttacaacatacctcagggattaaaacgtgaggctacacctaaggaaagtcggtcctaatcctgcgtttcctcctgcatgtcactgaccattggagtcactgctctctgaggaagacagtttacagcctgagcattcatgtcacgctcacagccaacctgttacttgctggcctcctttaccaagctccttgtttcatgaagaagttgtgaaactgaagttggaggaaaaaaattaagaaataaacctcaaaggtatttaaaagggcagtagagtaattactcctcacacccagggataaggatattctcatcattttctctcctcttgcctggagcataaacattcagatgtttgtgaagaaatgattaaaaggagagaaaatatcaggagaaaaatgattaaaatgagagaaatgttcttccactgactagacccattaaaggggaggatttaactttattgttagaggggtgaaaactggattttaagatatttcttcaccattttgacatatcttgggctgaacattttgattattttagagaatcagggagcttcagaaatgaagtttaatataaagtaagattgtctctgaaggaagaaattgtccttttaactcagtgtcaggttccgttttcttactcatatctaaacttcctgtcactccaactgaggctgcaccaggataagaggagggatttgaggaattagcgcgaatttagaagcctttgacttttgggaatttgcatcaagcagatagaagcaggcgggggctcagcttttgaagttggatcatccagctgtctcactttgccacttatgggatctgtgacttgaagcaggtgactgacctctccactcctcagttatctatgaaatggggataatactagcatctacttcgaaggcttatggtgattaaatgagataatgtttttaaggccctttcttcgcatagtctggcacacagcatttaagagatgttgactcgtgttcctgtagtagcagtactgactccatctcagcctctagtgaataaggtattcagagctggccaacaggaaattgctcattcttttgtccataagcagcaaaataatgccagtgtgacactgtcagagggctgcagtgtggtcagtggcctagagatgcagcttttactgttagaaaactcactcggatgttttagccgattcagaactcaagaaatgacaaaagtctgtgattggacacacttttttttttttttttgagacggagtttcagtcttgttgcccaggctggagtgcaatggtacgatcttggctcaccgcaacttccgcctactgggttcaagtgattctcctgcctcagactcccaagtagctgggattacaggcatgtgccaccacacccggctaattttgtatttttagtagatggggtttcttcgtgttggtcaggctggtctcgaactcccgacctcaggtgatccgctcacctcagcctcccaaagtgttgggattacaggcgtgagccactgcgccccgcctagagtattctttcaatattgacttgatttgtcatcatcatatcttttctattaaatcccttccacttccttcaatgaaatcgtatatgaaaacaaagggaatcggagcattttgcccacctcctagttggctgaattatttttgcctcccattcccatcttgaagtggtattcctcaaactcgtttctatgtttcctgtggttttaaataaaggaataatgtagaatggtatctattttggacattctcatcgtgaaaaggaactcttacacaaatacaaagccaagagattgtgttgccattgttgaagctgaaaaggacagtcactggatgcctccccacccaaggccaaggctttggtaggtccaggaagtgaaaaggaaagagaagctatgggagagacaaagggaagtaaaaaatggttgttcggctcagcataacaatcacttttgtggggcttattggttgtgcataaatttcatccatttgggcacacacacagatgtgacacccagaccactcagacacttggctaacactgatgccgtcatcctgaatgttgtttctggaaggactttcatgaatagaatctatttcagattggccgtaagtctcgatttattgatccgcaccactggactggggtggggttgtgtccactttttccctgccccttccctgctttggctcttgtgattgtgtcctccgtgtgtcaggcagagccctgtgaaggtgtggatatgtggccatattttacctgcataatctgcagttcatatgattcagcctaatgggttgcaatgccctgaggacagagaccatactttttcttcctttgtctttttagcgaaattcaatcctgttctgcgcctgcgccacagttgcaggctgtactgtctgccctgtgcatctcacacacccccactgcactgtgcacctagtgatggccgcagatttgcttttactcatcttccagggcctaccctgttaattccatcacagttgcaggctgtactgtctgccctgtgcatctcacacacccccactgcactgtgcacctagtgatggccgcagatttgcttttactcatctgtttgcagggcctaccctgttaattccatcacagttgcaggctctactgtctgccctgtgcatgcatctcacacacccactggactgtgcacctagttgatgaccacagatttgctcttacccatctatttccagggcctgccactgttaattcctaggaaaaaagaaaaaacaagcatggtggattggttaaattggcattttatattgtttgtgttcatggccatgccaatgataaacaagagctggtcatgggcattcagatcagatgagcaattaaatcccctccaaaaaacagaaacctacttttagagaagaaaagaattaaaccaagatctttcagggttttgcttctccttttgtttttaaggcacttaaataaatggaagaacatgtaagctaaccgtgtttagagtactatgttttactagaaagtgctacccttctgcagatttctcctcaatgaaagaatgccactgaagcacctttaatggtgcctttatcctatagtcttattgaatcattctctttagccaacataaaatacaaagccagggtataagacttcatgtaggtggtaatttaaactaacaattagtgaggccgggcgcggtgggtcacgcctgtaatcccagcactttgggaggctgaggcaggtggatcacaaggtcaggagatcgagaccatcctggctaacacggtgaaaccccgtctctactaaaaatataaaaaaaaaaaaattagccgggcgtggtggcgggcgcctgtagtcccagctactcgggaggttgaggcaggagaatggcgtgaacccgggaggcgcaacttgcagtgagccgagattgcgccactgcactccagcctgggagacagagcgagactccgtctcaaaaaaaaaaaaaaaagaaaacaattagtgaatttttgctgatgctttccttaaaccccttacttagcacttagttctggattcttaaatcctgataatggactcatccttctcggtctagttaccccagtaagtcccaaggtcatccatatgaggtcctccttgatcttactctgaatagaattaactggtctcttctgtttttccatagcattgactcatcgtgttagaccagcttgaattgtgagcctttctaaagcagggtctgtataatttacccttatatttgctctgtaggcagagaaaatattattgaagtaactagatggtaaaattaactgtgcaatcagaaaagaagttagaaaaaattattaaaattttctgtgaaaattgttttaattttattaatatattaaagcattttgcagactattccataaagaattttattacattggctctcattttaaagaaaacattataccaggtgtcagaactcaatcatatttgtaggaagaataagccttggccatcaacaacgcttctttggttacaggattacaggaactgctgagaatgtaagcactttccgaagtccacaaagaactcatttaaagctcgtacaggcagtttcaaattagccagggaaaagttaatggtggggaggtaaggtcatagaatgctctataaatggaggcgacgtggaggacagttgcagttgtataacatttgattgaaggagagggatttggacctgaggaaaccaggtctataaatactaaggctggctgggcacagttggctcatgcctgtaatctcagcattttgggaggctgaggccggtggattgcttgagcccaggagtttgagaccagcctggacaacatggtgaaaccctgcctccaaacaaacaaaattaaccgagtgtggtggtgtgcacctgtagtcccagctactcaggaggctgagatgggaggatctcttgagcctgagaggtagaggctgcagtaagcccagattgcaccactgcactccagcctggtgacagagtgagactccatctcaaacaaacaaaacgtacatgcatatataggctgtagactaaatagtgaaatattactaagaaccttcatcccaaggggttgagtggtagaaccactgagaatattgttgctgctcttttggagacaacaaactgcattaataaaagtctgagaacaagaaagttgagttttcaagtaatgtcctttgcatattgctacatagggctcatctgagtctgtgatgttctactttgttgatgaaagaaaacaagtggaaattctgctcccccacacatcctgcactgcaaaaagataacaagtagcaggagatactcaattatgatgcagttcaacaaagaaaacaaattaaaataaagagatcctgggtggttaaatacagagtctcctttgtaaacagcaatggatgatgatgatgactgttaccagggctctgtatgatcattttcccaattctttggagtacttttttcaaaagcactcttgtagaattaactggaaacatagactacccttcactcattacatgggaaatgggattgaattctcttcttggcaatggaaaatacttgatgcatgcaaataagaaaactcttactttttccttctctccttgcagggggagcacgcgtcctaagcttgccaggaagccctgctctcctgccctgggcacctccgttccacttgaccttttccacctgtactccctgcattttggtctcttgctctggtctttagccttcgcattttcctgatgcagcccaaaccagtcacctctctcctagattcattctctgtgctcagaccatctctttcctttagttcctgtgacgaaagaaaatgtatttggccattggaggtataagcaacaaagaatccaacccacacagctttatatatgcaggttctctatatgctcttcttgtgaacagcgtggggagaggaaaatagacttggcaagaggactaagaacagaatcggacagttatctgatggctttcctaaggttcaggaaagaacagtggtccctttgttgggcctttctgttgtttctttgttttcaatttcactgatttctgctttttattttctattttcttctgtttcctttggaattcttctttttttttttttttttttttacttcttgtattaggctcatgctataacaaacaacccccaaatctcagtgactttacacactaagagtttacattttcctcatcaacgtccactttggatgttccaggttgggtaatgctctgtggctgtcctctagctagtgactcagggacttgggttgctcctggtgtctccagcgtggttatggtgtctccaattttggacttcaaggtgacccaggcattatccacctggtaaattgggagatgggtcccaggaaagtgaatactcaaccaacctggcctagaagtgacaataataaggccatgtgtggtggctaacagtcagaaacccaacaattgggagattgagctgggaggattgcttgagaccagaagttcaagaccagctgggcaccatagtgagaccctatctttcaaaaaaatataacaaccaggcttggtggtgtacacctgtggtcccagctatttgggaggctgaggtgggataatcgctggagcccaggagtttgaggttacagtaaaccaggtttacaccactgcactccagtctggatgacaaagcaaaaccctcatctcacaaaagaaaagaaatgacaatcacagccactgcaacttcaaggaaggttgggagagtgatattggtcaggatgagtggtctctgacatgtttcttaagttggatatttagcttattaatttacaactcttttctaatattaatactcaagactacattttccccaaaacatttattttgccatgttttgcaaggcttggtatatggcattttcattactctttaattctaactaatttttaatttctattatgatttattatttgatctatgaatcattttgaaatttgtttttgtaaccttggatagggaaagatttcttatagaagacagtaaaagggctgagtacaaaagaaaagactaataaattcagctacgctaaagcttagaacttttcctcatcataggacaccttaaagaaaatttttaaaaagttacaaattgggagaagattaaaaagtcctaagggttagcagtaagaatatatacatataattattacaaattggcaagagaatgacaaatcaacacaaaaacgagcgaaaaggcattttgcaaaagagaatcagatggtccatatgcatgtgaagcgattttcactagcgagcagggaaagtgaagtcaaaatcacagggagatgctgctctctacctgactggcaaaactgaaatgattagaaaatacttggaggatatcctagaacgatcagtgggatctggtatattatgtgtatgaggttaaattagcagtgagtattcacataccctatgactcagcagtttcattcctagatatatatcctggggattagaaacactaagtaggtgggtgcagtggctcacacctacaatcccagcactttgggaggccaaggcaggtggatcacttgaggtcaggggttcgagaccagactggccaacatggtgaaaccccatctctactaaaaatacaaaaattagccaggcgtggtggcgggcacctgtaatcccagctacttgggaggctgaggtgggagaatcgcttgaaccccggaggtggaggttgcagtgagctgagattgtgccactgtactccagcctgggcgacagaatgagactccatctccaaacaaacaaacaaacaaacaaaccactaactacctcagaggacaatgctaacatttcaaagtgttctagaagttggtttcccagaaaagaagtcaggctcttgtggagctccatggaaactggcaatgacccatgacttagggcagtgaagtctcatcaaatgcaaggcttagaccccattctgctgctgccgtcaggggaggcaagggctccttgttccccaaacatcgatgctaatgaagcaaatcctgctgctagtttgcagtgttgcctagctgcaaacacaacctctgatgatgccaatagagaggctggtgcctccttcatcatagagcttacaatccccacaaggtttcgggaccctcttttggattctgagggtgggctcctttagccatctgtttagtgccccagatgaaattgacagcaggggacctgcactccttctactgctttttctcaaggcatccccagcagagggtctctagggtgcctgttatgtgtgctgtttggccatctgcctttgtagaacacagcccaatgtctgttggcaaaaaaaggtttacatgtggtatattcttaccatggaatattctgcagcaagtaaaaatgaataaattacagctattcatatcaaagagatggattttattaatatagtgctgagtgggaaaaagcatcagaagacaacatataatggtacactctttttttttttttgagatggagtctctctctgttgcccaggctggagtgcagtggctccatctcggctcactgcaacctccacctcccaggttcgagcgattctcctgcctcagctgcccgagtagctgggactacaggtgcgcaccaccacaccaagctaatttttgtatttttaatagtgacggggtttcaccatgttggccaggatggtctctgtctcttgacctcatgatccgcctgcctcagccttccaaagtgctgggattacaggcatgagccaccatgcccagctacattctttttaaacattcagaaacaggtaaaactgaaaaatatataatttagacacaacacttatgtgaaaagaccaagtttaggatgttggttacctgtgacggggcagcaagattgtgggaaaggaaggaagctacaggtatgtgacagagagttgcattagcccaaatctctacagagctggtgtcaaggatgaaactattggtgttttatttggaagatacaagcccaaggcgaggtgagaaaaaagagaagggaagcaaaagaagacacaaagtgacacaaaatggcatgaactaaattacgttctctccaaattcacatattgaagtcctaaccccagtacctcagaatgtaactgtatttggagattcggtctttaaagaagtgattcaggctgggcctgattgctcacgcctgtaatcccagcactttgggaggccgaggcaggcggatcatgaggtcaggagattgagactatcctggctaacacgatgaaaccctgtctctactaaaaatacaaaaaattagccagttgtggtggcaggcgcctgtagtctcagctacttgggaagttgagggaggagaatggtgtgaacccaggaggtggagcttgcagtgagccgagattgtgccactgcactccagcctgggtgacagagtgagaccccgtctcaaaaaaagaaaaaaagtgattcagttaaaatgcagtcattatggtgggctcaatcaaggacatgtggacacagatatgtatgcacatggaggaaagaccatgtgaagtcggggagaagaaaaccagctacacactaaagaaagaggcgtcaggccgggcgcgatggctcccgcttgtaatcctagcagtttgggaggccaaggtgggcaaatcacttgaggtcaggagttcgagaccagcctggccagaatggtgaaaccctctctctactaaaaatataaaaattagctgggcgtggtggcatgtgcctgtaatcccagctacttgggaggctgaggcaggagaatcacttgaacccgggaggtggaggttgcagtgagccgagatggagccactgcactccagcctgggcaacagagtgagactccatctcaaaaaaaaaaaaaaaaaaaagcctcagaagaaaccagtgctgctgacaccttgatcagtcttccacctgcagagctgtgagaagacacatttctgttgtttaagctacccagtctgtggtattttgttatggcagccccaacaaactaatacacaaaatgatgcacagccttgctgactatcacttcaaaatgagccaaacagagacacaacggggcactaggcaattgtgtcccactcagtgaaacttctctggaaagctgtaaggtatagtccagagacgagaggaagggaagaagaaatttatcctctgggagcctcccatttcctgtctcctaatagtgagaatttttccatgagaagttaatgtccctatactttcacaatgtgttaccttcttttgttgctgttcaagatgccaagcctatgccctgcagtgtggccttttgtcagagtccataaagggcaggaggaactaggaactctgggtgtgtatggttggcccagctgcagagttgacagtcaaggggataaccaactctaatcagcctagaagggaacttggtagcctaggtgagttggtcaggcacaggctggggctaaggcaaggcaaatggctgaggtctaagacgtaggtggtgctgagaaaatgtggggaagcatacaagatttgtgactgatgagtaatattctagttcttggttaggataatgggtacatggggtgttccttttattattttcaaaatgaaatgaaataaaagagggatatgtgtggactgatgatgatgtataatgaatcaaagattatgattaacttaactctgcatacttgagtttgtttatttttctataaaaggagaatagcaatattaagtcttacagcccaggaatgaaatgtctttccatttgtttgtgtcttctttaatttatttcatcagtattttgtagttttcagtatacaagtctttcacctccttagttaagtttattcccaagtattttattattttgggtgctattatatatgggattgtttcgctaatttcctttttagatagttctgtgttaatgtatagaaatcgcaactgatttttgtatgttgattttgtattatgcaactttattgaattcctttattctaacatgtttaaaaaatggagtcttagggcgttctatatatgagacgatgtcatctgaagacagggacaaaacaattctacagtccatatgaaaccacaaaagaccatgaatagccatatcaatcttgagaaagaagaacaaagatagaggcatcacattgcttgatttcagaatgtataacaaaactacagtaatcaaaacagtatgttactggccaacagatagacatatatgtgaatggaacagaatagagagtccagaaatagattcacatgtatattgtcaactgatcttcaacaatggtgccaagaatacataatggggaaaggatagtctcttcaacacatggtattgagaaaatcagatatccatgtgcaaaagggggaaactggacttttatcttacatcacatacaaaacccaactcaaaatggattaaagatttaaacataaaatctgaagctgtaaaactcctagaagaaaacataggcgaaaagctctttgacattggtcttgtcaatgatttcatggatatgacccccaaaacacaggcaacaaaaacaaaaataagcaaagttacatcaaatcacaaagcttctcacagcaaaggcaacaatcaacagagtgaaaagaaaacctatgaaatgggagaaagtatttgcaagcgatgtatgtgataagggttgacatctaaaatatgtaaggaattcataactcaatagcaaaaaaaaaaaaacccaatttttacaaatgggccaaggatctgaatagcatgggctctggcatcttgaacagcaatgaaagaagctagttgacacattgcgagagtatagggatattaacctctcatgggcaaattctcatcaatgagaggaaatgggaggctcccagaggataaaaggtgctcatcatcactgatcatcagggcaatgcaaatcaaaaccaccgtgagatatcaactctcacctgtcaggatggctatcattgaagaaccaaaacacaacaaatattggtgaagaagtggacaaattggaacccttgcatactgttgatgggaatgcaaaatggtgcagccactaaggaaaacagtatgggtgttcctaaaaaatgtaaaaatagaactgccatgtgacctagcaaccctatttctggatatttatccaaaaaaattgaaatcaggatcccaaagaggtattagcatttgcaggttcattgccgcattattcacaatatccaagatacacaaacaatctaagcgtccatcggcggagaaatgaataaagaaaatgtatatacacatacaatggaatactatttagcttttaaaaagaaggaaattctgcaattattcaacaacatggataaatcttaaggacattacgctaagtgaaataaactattaacagaaagactaatatggcaggattcaatttatgtgggatatttaaaatagtcaacttcatagaaccaaagagtgaaatgatggtggccaggggctgaggggagtggggagttactaatcaataggcataaagtttcagtgaagtcaggtgaataagctctagagatttgtggtacaatattgcacctatagtcaacaatactgcagtgtacactgaacaatttgttaagatagatctcaccttgtgttcttactgaaaaaaaaaaagaaagaaaatagaacagaaaagcaattggattttaattctggaaactcctttctcttccttacatccaggaaatttgctgtttattttgaaaagcaaatttaaacctatttaagggagagagagctcttgtaaaaattcatttattagttctggaccaatgttatttataagctattatttcaaatgataaaaaataaatgcataatacatttgatgatagaacatttttctttttaaataaggcctgatttttcaaaaagcattgaatatgtttgtttctaatttccaaagcttgacagtttcttatgtttcattaaaagcagaagaattgttatgtatgcatgttcatatcacttttgaatgactcatgtggctacaaatgcagcaatctgtggttatcatggaccatgaactagataaacattcctgcttttcttaacattcctttcctgtgcctcattaactaatgtacataataaaacatctttatttcattttctttgca

SEQ ID NO: 4380 - DNA, 2347 bp, Homo sapiens
  ENST00000433165
gtcagtgtgttaatgaatgttttgttgaacccttttcatctatcaaggactgaaatatctgatttaatctcagtggtgcttaaaataaacttttgtggctgagtttactcaagcccttatttgaaagctattcttataggcaggcccagagctaaagactgccagcttgttggcccactgctgtctgttcctgggggcacattgggagccgtcgtcaggtttcttgacttggacttctgacttactactctctggacagtctggagagtaggtggatttcagttcagttatttttgattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaa

SEQ ID NO: 4381 - DNA, 2023 bp, Homo sapiens
  ENST00000479339
acatgaataaacacggtgcagtccagaggggcagaagggagaagtgatgaatcttgctggtgaggaagctggtgcgtggttggtgtccagagaaggcctcaaaaaggaggagaagcttctggggagccttggaggatcaggaggagttggccagaccagatagggttggatgactgcctgcaacaatatgtccacaagtttgaacgagagaagatcaacggcgagcagctgctgcagatttcccatcaggacctggaggagctgggggtcacacggattggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtctt

SEQ ID NO: 4382 - DNA, 536 bp, Homo sapiens
  ENST00000424998
aacattaaacctggggaaggcctgggcatgtacatcaaatcaacctatgatgggttacacgtgattactggaaccacagaaaatgtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccac

SEQ ID NO: 4383 - DNA, 776 bp, Homo sapiens
  ENST00000454664
gtcagtgtgttaatgaatgttttgttgaacccttttcatctatcaaggactgaaatatctgatttaatctcagtggtgcttaaaataaacttttgtggctgagtttactcaagcccttatttgaaagctattcttataggcaggcccagagctaaagactgccagcttgttggcccactgctgtctgttcctgggggcacattgggagccgtcgtcaggtttcttgacttggacttctgacttactactctctggacagtctggagagtaggtggatttcagttcagttatttttgattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagctctatgcaagagatattatcagtatcactcctttacagaaga

SEQ ID NO: 4384 - DNA, 5217 bp, Homo sapiens
  ENST00000393892
gggtgcccgctccgccccccgggctatgtaaagcggccgggctcgggtcgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctagctgtgtgcagtctctcttacccttctgtgcccagctcagtcttccctagggctgggtgtattaggactggctttgtcccacagcttggggccatcggtcctgtctcccctctgctggccgggcacagctgtggtgaggttgggcagctgaacagtgttggctttcatgaggaggcagaaagcagaggctggcctcagactcatacagaaggtgggggttggctgggtacgagggatgtggagcacaaaagcctctcatcccccattaaccagggcaccaagcccacaggtgtccccagcccactggatcagaaagagttcagtaagaccggaagctcctggtatgggtttctcccagttctctagggaaggccacctgcaggtcactgaaacttcaagcaccagggaagatctaacatttgagtcccttccaggccatcagaggcctagtcagccacatgggaaacttccaagacctgactcaggcatcattccaccatggctaaggcaccagccggggaagacttgaaagaaaggggcaggagctcagatgaagagaaatcctaagttacctttctaggtcaaggcctgtccctggccatctctgaacttcagctagagcttcaagtctgtgcctggagctcctgggaaggctactcaccttgaacaccacgcttgacaggacagcatggtgcatgccgctgcatccgtgagcagtgtgtctcctgcatgcagaaagggagcagagaaggccaggggcttttgctaaaaatagtggccagaccagagctctggagccacctgtcccacctcaaatgggtctgggggtcaggaggcagggttttatctctgtctaccatctccctcgaacccacactgcaacaggaactgtgagagtctttgtaagtaaactgccctgtctaggtcagtacccacctgagctttggacgcacacagcttttagtacccacctgagctttggacacacacagcttctagtgatttctggggccccaccgtaaagtgagcatgctttctgaactcgcttctctgtgactgatgttaggctgggcccagaggcacagccggggcctgcctagcactcacatgctggacaggtctgggagaggcagagtgccccacctgccactaggctgggtgcccacagcccgcatgcagcagcttgctgcaccccaagtccaggtcgggctcagctctggctcacagactggagacaatgcagatgccagagcaaagggccaggaagggtcaaaacattttattctcttttttttttcttttttaataaagttaaacagtaaaacaaaaattcacaagctgcctccctgtccacccccgcctccctcccctgccctcggtcttcggcattggttccctttgctccaccccactcacagagacacagggcatccaactgagaaaacgaaactgctctaagcacacggagacgtgatgaagggaggaggtgaactgtttccacattcaagattaaactgagtgaatctgcattttctgggttctgggtggttgcccttcattagccaaattgaaaaaagaaattccctggaccagatgctgaaagagaaaagaggggttggtagttggctatggattttctaaggaagatcactttgctctgattatggaaaagtcttcaagggctgcttcaaactcaaacacagagagaaactctatgggtatcaaacagctcaggctgtttttgggtgcaagagggagcacgtgactgtattatacatgggtagcttctgacctcagcattatctatatagtacctttgctcttgcagagaagccttggtactaggcagttagagatgcctccctgaccctgcagagatgcggtggctaaaggtcccaaggcaaggggtgcctgggaaccttcctgtcttcatccttagcaacagccgagtggatagatgccctgctagatgagaattcagctgcccccgctcatgggcccctctgactcccaaagagctgcctaagaggcaatgagtgtgttggcttgtgatctgggaactcccaagaacagcaggcccacctaccttcaaagctgaagccgccaggaccgccaaagaatgccttgaagatattgtttggatcaaaatctgtagagcagggcaagtaacatggaagggaagaaaaggtgaaaaattagaaatgttcgaagagaactgatgacactgagaacagatctccaaagctttcctggagagtctcactcccctcctttcccaacacttcagactgcaagtgagcaaacctgccccatcccgtgcaaaacatgctacctgatcccactcctaggacatgttcccttctccttccaactgctgccccaaaggaagctttctctgcttcagcttgcttcattgggctgttttctcaacaaatggaatgccatttgcacttacacaagactttccccatactctgtctccctataatgctggagcggctactaaaaaggataaaatgtatcacttaaatgttaccaaaaataaatataagagcaa

SEQ ID NO: 4385 - DNA, 1019 bp, Homo sapiens
  ENST00000472031
gctatgtaaagcggccgggctcgggtcgtgccaccgctggactcccgtgtccctccgcgcaggcgggcggccccggagcgctggtgccggcagaggcggcgacggtggcgcccctcctcatcatgtcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccag

SEQ ID NO: 4386 - DNA, 576 bp, Homo sapiens
  ENST00000591945
accgctggactcccgtgtccctccgcgcaggcgggcggccccggagcgctggtgccggcagaggcggcgacggtggcgcccctcctcatcatgccgtggcagctgtggcttggcccagacacagagacccccacctccaaagaggacgtccttagtaggtgccaagcatataagagtgaggccagtcccagaaccgcaggctcctggcgcgccccgcatgcctccagcacgtttacctttccgaagtggcaggaatggggaaagcgcacgcttaggagagcttcagacaagcttccctcttcctcctccacgaccagaagcggaaaggtgctcccggaccgaaagggaaagaaggtccagcactgccccgcttgggaaggcacccacaaccagtctagggactaggggtaaggccggcggggagcccgcgaatgacctgggctgacatctcttcccctccttacacagaacagaggcttctcccgaaaaagccacacattcctgcccaagatcttcttccgcaagatgtcatcctcaggggccaaggacaagcctgagctgcagtttcccttcctt

SEQ ID NO: 4387 - DNA, 587 bp, Homo sapiens
  ENST00000592446
gctggactcccgtgtccctccgcgcaggcgggcggccccggagcgctggtgccggcagaggcggcgacggtggcgcccctcctcatcatgccgtggcagctgtggcttggcccagacacagagacccccacctccaaagaggacgtccttaaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgc

SEQ ID NO: 4388 - DNA, 581 bp, Homo sapiens
  ENST00000587679
gctggactcccgtgtccctccgcgcaggcgggcggccccggagcgctggtgccggcagaggcggcgacggtggcgcccctcctcatcatggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccct

SEQ ID NO: 4389 - DNA, 2583 bp, Homo sapiens
  ENST00000393888
ctccgcgcaggcgggcggccccggagcgctggtgccggcagaggcggcgacggtggcgcccctcctcatcatgaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctagc

SEQ ID NO: 4390 - DNA, 622 bp, Homo sapiens
  ENST00000441615
atcatggtgagaggccgggcggggccgggcacggggtagcaccagggcgggaaacgagtgtcggggcccctcgggaggaagcgtcttgcaaacgaggacccggggctccgggttcgacttccagttttcttgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaaga

SEQ ID NO: 4391 - DNA, 516 bp, Homo sapiens
  ENST00000589772
gtcccttgtggcttctagaagataggaaaacaagtggctccgagaggcgcttctgacacacagcacagcggcgggtagagctggatcctaattgcagaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagta

SEQ ID NO: 4392 - DNA, 689 bp, Homo sapiens
  ENST00000585452
agtcccagaaccgcaggctcctggcgcgccccgcatgcctccagcacgtttacctttccgaagtggcaggaatggggaaagcgcacgcttaggagagcttcagacaagcttccctcttcctcctccacgaccagaagcggaaaggtgctcccggaccgaaagggaaagaagaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacct

SEQ ID NO: 4393 - DNA, 1517 bp, Homo sapiens
  ENST00000592861
atttttagtagagacagggtttcaccatcttgaccaggctggtcggtagcacaaaagaaaggaggggcccttggcccaagatgggacgaatcaagcttgacaggatgattgccagatcttttttttttttttttttgagacgggggtcttgctctgtcgcccaggctggagtgcagtggggcaattcggcttactgcaacctccatctcccgggttcaagcaattctcctgcctcagccacccaagtagctgggattacaggcacccgccaccatacctggctaatttataaatttttagtagagacagggtttcaccatgttggccaggctggtctcaaacgccccgcctcaatttcccaaattgccgggattacaggtgcgagccactatgcccagcctattttatttgtaaaggaaaactggatttttctgcccaggattagagcaggagaaatgtaatgggccagcaaggctgctctcaggagaggccttcctcccctgtggagggcgagacatcctcatggggactcaattcagaacataacaggaaaaagcgagtgactccaaagacagccacaggtgtggagtctggaaatcaaaatcacagatactccactcctctttgtgtcttccagccccataatgtcaccccattatagtccaagacccttcctgtaccaggaggcccccccataggcctgcaaggtgtgtattaaactgatggtgacgttgtgactgcttgtccagatgggcccctgagtgaaatggggcactactgatagttccctggtggtcctgggaacactggggtatatggtcaccctaactgttgtgctggattgatagatagggttggtcacttgcccgaggccgatggctggtacatggcagagctgagatattcactgtgttctggctgtttccaccgtaccatgttgttcccagccctctgttttctttccaccccacttcccatgacttgcttcccctttgagacgtggtgctagtaaatcttagattcccttggcctgtactgcctgcctctgttacaaatgccttagagtttggagaagagatggaaagatctatacaatgtaaagccagagaattttaacttttttttttttttttttggagacggagtcttgctctgttgcctaggctggagtgcagtggcactatctcggctcgctgtatcctctgcctcctgggttcaagcaattctctacctcagcctcccaagtagctgggattacaggcgcccgccaccacgcctggctaatttctttgtatttttagtagagacggggtttcaccatcttggccaggctggtcttgaattcctgaccttgtgatccacccacctcggcctcccagagtgctgggattacaggtgtgaaccaccgcacctggcctgagaattttaactttttattgctctaaagttgccattagtttgaccaactaaccaatgaatgagctgtagtgggttgctggagaggtgatgcttagtgt

SEQ ID NO: 4394 - DNA, 572 bp, Homo sapiens
  ENST00000592105
agtaaatcttagattcccttggcctgtactgcctgcctctgttacaaatgccttagagtttggagaagagatggaaagatctatacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaaga

SEQ ID NO: 4395 - DNA, 911 bp, Homo sapiens
  ENST00000486438
aggctggtcttgaattcctgaccttgtgatccacccacctcggcctcccagagtgctgggattacaggtgtgaaccaccgcacctggcctgagaattttaactttttattgctctaaagttgccattagtttgaccaactaaccaatgaatgagctgtagtgggttgctggagaggtgatgcttagtgtccgagtgttttgcgctgggcctcggtggtcctggtggcggatgttggtatgcccctgctcccctgccctgactgcacccgttttctcccggcagtcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggg

SEQ ID NO: 4396 - DNA, 560 bp, Homo sapiens
  ENST00000406197
aatgccgggagagcaaagccgctgagagtttgtcccgttagatccaggcgtgaaggacggactgtactacagggagcagatccccctagctcagtcggaggcgttcctaacggatcttttggagaaagtctgtgagcgaatgaacgactacaagcttgaggaagaccctgtgacgaaggagagaactttcaagagattcgctcctaggaaaggagacaaaatataccaagaatttaaaaaattgtatttttattctgatgcttacagacctttgaaatttgcgtgtgaaactataatagaagagtatgaagatgaaatatcctcacttatcgcccaggagacacactatctagctgacaagctgtgcagtgaaaaatcagatctgtgtgaaacttctgctaatcatactgagctctaggagtgccgttctgctggtcgtagagaggagtaaagtcacacccaaaggtttcagatgaggaaaccaaggcccagagaggaaaaggcacagcaggcatgacaccagtgccatcggtgtttgcttcacccttgcagattacgag

SEQ ID NO: 4397 - DNA, 2378 bp, Homo sapiens
  ENST00000321736
aatcctcttggtgggtgctgaaacaatgccgggagagcaaagccgctgagagtttgtcccgttagatccaggcgtgaaggacggactgtactacagggagcagatccccctagctcagtcggaggcgttcctaacggatcttttggagaaagtctgtgagcgaatgaacgactacaagcttgaggaagaccctgtgacgaaggagagaactttcaagagattcgctcctaggaaaggagacaaaatataccaagaatttaaaaaattgtatttttattctgatgcttacagacctttgaaatttgcgtgtgaaactataatagaagagtatgaagatgaaatatcctcacttatcgcccaggagacacactatctagctgacaagctgtgcagtgaaaaatcagatctgtgtgaaacttctgctaatcatactgagctctaggagtgccgttctgctggtcgtagagaggagtaaagtcacacccaaaggtcaatgtctgcattttatgtttgcatgttgtctttcatgataagaaaaattttgtctcttgtttataccgtgtttgtctccgtttatgattcattttgaaaatctgttggttgacatcatgacaaaccctgcgtttttttataggtgaagctgaggagtacatgaaacttaaattaacctttgcagattttgataaatcaagcttgacaatagaggatttaattctgtattgaggaaaaaagcgaagacatttcataaacaaaatagggatttcataatgtatgctgcttattttataacagtgtatgtgcacatatgcaagcgcagtggctgtctgataagaactggatttgaatcctcaaatacttgattgcctataaatttaaggaaatacatggcaacaaattcaaaatgtggccttctgggtgagatatggctattagtgaaagaaacccactttttatcaggaatgaaattaaaatttttagaaaccacaagtttaaaaacccatctctaaaatttagtggaatgtgtaaaaactaatgaatgctttaatttatagtaaacaataattatattggcctctcaaacaccattctgagtttaagtggcttagaaagttgatttattattgcatcaggtgttaaaagatgacactagtgattgcgttttgtttcgctccaaactcttctggcttgtttgtttttcttctaaacgttttttttttggctcacatttagtgtgttgagtttactactaaataatctaccattcttctacaggaatggaaaaagagttgggacctggtgggaaattatcttttggccacacttaatatacaaagtctagtaacaatcactcccggaaatttctttatctctgttacatttgcattcaatggaatctgactttaatgattaaaaatgtcagggtatggtctacaccagtttctaaaaagagattctcattgtctttggtgacaatcaagtgggtaggatgctacaaatcccccccccaacccccccgacccaaaactctttgccatattgttacttagttgcttaaaaagcacattatgtgtttaaatcattctcctgactcttcagcaggaaacaattcttaaatttaggaaaatttaccaaagctaaggggaagggctttccatgccccctccccacctaaactctgattaaaagttagtgagttaatgtcacttaattacttgggtgcttcttttttgtcttgtctgtggctgcttaagtctgatggctcctacataacccagcgaactcgcacccgagctgacacacgatggaaatagaactgaataataattaacactattttccagtagggtaggacaattgttatttaaaacatagtccctatagctttatttaaacgtatctagttaaggttaatttggcatttaaagtagtaaatcaggaacattctcctaacttggattttcttgggaaatgcactaaacaggacaattattcctgaaaacctagtgaccttcacaggaacatggcgggacctgtgacactaagtaagcttcagtgaaaactgttcacggtcgtaaccgtagaagtgttgccaaatctgtttccatactctctttgatcatcatcaaacattctcaaatgtaggcaatgctaacactaattatagaaattaagaaaatgtgggctcctgtttgtaactaaacggacgtggggaggtgcacctcctgtcactgaggggtgcctttcatggacagtgatgctttgctttgaatggagagggcgaggaaccttgacttacagtgactatctaaggttgtgataaatatggcatttcaggtttttttcttggatttcccattaaaaatagtcttgtatcttgc

SEQ ID NO: 4398 - DNA, 1637 bp, Homo sapiens
  ENST00000636446
actgcactccagcctgggtgacagagcaagactctgtctcaaaaaataaataaatgaataaataggaaagcacatttgaaggctgcacatggtggctgatacttgtaatcccagcaattcaggaggccaagcgtgcagggcgctgatggacgagatagagcacgacatcaccaaggctcggcagaagaagaccaaggtgggatccttccgaatcaatcccgatgggactcaggagaggagaaagatccccctagctcagtcggaggcgttcctaacggatcttttggagaaagtctgtgagcgaatgaacgactacaagcttgaggaagaccctgtgacgaaggagagaactttcaagagattcgctcctaggaaaggagacaaaatataccaagaatttaaaaaattgtatttttattctgatgcttacagacctttgaaatttgcgtgtgaaactataatagaagagtatgaagatgaaatatcctcacttatcgcccaggagacacactatctagctgacaagctgtgcagtgaaaaatcagatctgtgtgaaacttctgctaatcatactgagctctaggagtgccgttctgctggtcgtagagaggagtaaagtcacacccaaaggtcaatgtctgcattttatgtttgcatgttgtctttcatgataagaaaaattttgtctcttgtttataccgtgtttgtctccgtttatgattcattttgaaaatctgttggttgacatcatgacaaaccctgcgtttttttataggtgaagctgaggagtacatgaaacttaaattaacctttgcagattttgataaatcaagcttgacaatagaggatttaattctgtattgaggaaaaaagcgaagacatttcataaacaaaatagggatttcataatgtatgctgcttattttataacagtgtatgtgcacatatgcaagcgcagtggctgtctgataagaactggatttgaatcctcaaatacttgattgcctataaatttaaggaaatacatggcaacaaattcaaaatgtggccttctgggtgagatatggctattagtgaaagaaacccactttttatcaggaatgaaattaaaatttttagaaaccacaagtttaaaaacccatctctaaaatttagtggaatgtgtaaaaactaatgaatgctttaatttatagtaaacaataattatattggcctctcaaacaccattctgagtttaagtggcttagaaagttgatttattattgcatcaggtgttaaaagatgacactagtgattgcgttttgtttcgctccaaactcttctggcttgtttgtttttcttctaaacgttttttttttggctcacatttagtgtgttgagtttactactaaataatctaccattcttctacaggaatggaaaaagagttgggacctggtgggaaattatcttttggccacacttaatatacaaagtctagtaacaatcactcccggaaatttctttatctctgttacatttgcattcaatggaatctgactttaatgattaaaaatgtcagggtatggtctacaccagtttctaaaaagagattctcattgtctttggtgacaatcaagtgggtaggatgctacaaa

SEQ ID NO: 4399 - DNA, 2259 bp, Homo sapiens
  ENST00000636372
ggggctcgatctgcctccgcgccagctggccgcgcgcccctgcccagcaccctcctgccggctgccgccctgaatcgctgcccggcgctctgagcatcgtggcatgtcctggggtctctgggccgggagtagctttgctgagagaaccctgattttgttcagctttgccaagagctgcagaggactggctggcccttcccagcccctgagggtgcggccccattggcctcagccaaacaccatcattgcgtctccacgccaggacgggggctgggccaggctgcgggacagctttggccaatgggagcgggaaggggcttgcgggggtgtcaggcaacgttttccttacaaatggaagttgacagggcagtagtgatcctccacacctccagatgtagggctctgagggtttgaagcttagaaccgcggacaccatctgacatccctgtgggaagaccaagaacgttgcagagaggtggagacagagtcaggaggtgcctgaggggctgaggccaccagtgctgacgagccaacctgtggacgtcttgccctgtggacatgagatttccccttactgctggttatggcttaattgtgtctgccccaaattcatgtgaaattcctaacccctaatgtgactgtgtgtgaagatgggcccagtgacctctaaagaggtcattaaggtaacatgggatcttggggtgggccctttagacaaggcccatattaaacttatgactggtgtccttataagaagagaagattaggacacagacacacacagagggacggccacgtgaggacatagggagaagacagctgtctgcaagtcaaggaggggcctcagaaggaaccaaccctcctgacaccttgatcttggacttccagctgcagaacgcgtgcagggcgctgatggacgagatagagcacgacatcaccaaggctcggcagaagaagaccaaggtgggatccttccgaatcaatcccgatgggactcaggagaggagaaagatccccctagctcagtcggaggcgttcctaacggatcttttggagaaagtctgtgagcgaatgaacgactacaagcttgaggaagaccctgtgacgaaggagagaactttcaagagattcgctcctaggaaaggagacaaaatataccaagaatttaaaaaattgtatttttattctgatgcttacagacctttgaaatttgcgtgtgaaactataatagaagagtatgaagatgaaatatcctcacttatcgcccaggagacacactatctagctgacaagctgtgcagtgaaaaatcagatctgtgtgaaacttctgctaatcatactgagctctaggagtgccgttctgctggtcgtagagaggagtaaagtcacacccaaaggtgaagctgaggagtacatgaaacttaaattaacctttgcagattttgataaatcaagcttgacaatagaggatttaattctgtattgaggaaaaaagcgaagacatttcataaacaaaatagggatttcataatgtatgctgcttattttataacagtgtatgtgcacatatgcaagcgcagtggctgtctgataagaactggatttgaatcctcaaatacttgattgcctataaatttaaggaaatacatggcaacaaattcaaaatgtggccttctgggtgagatatggctattagtgaaagaaacccactttttatcaggaatgaaattaaaatttttagaaaccacaagtttaaaaacccatctctaaaatttagtggaatgtgtaaaaactaatgaatgctttaatttatagtaaacaataattatattggcctctcaaacaccattctgagtttaagtggcttagaaagttgatttattattgcatcaggtgttaaaagatgacactagtgattgcgttttgtttcgctccaaactcttctggcttgtttgtttttcttctaaacgttttttttttggctcacatttagtgtgttgagtttactactaaataatctaccattcttctacaggaatggaaaaagagttgggacctggtgggaaattatcttttggccacacttaatatacaaagtctagtaacaatcactcccggaaatttctttatctctgttacatttgcattcaatggaatctgactttaatgattaaaaatgtcagggtatggtctacaccagtttctaaaaagagattctcattgtctttggtgacaatcaagtgggtaggatgctacaaa

SEQ ID NO: 4400 - DNA, 6031 bp, Homo sapiens
  ENST00000369501
cgagagggagccagagacagcgcgagcggagggagcggcagggactgcgcgagcgggacgaggcgacgggcgcccgggctggcggagacgggcggccccacgccgggccaggcggggctcgcgggaggacccagtgaagagcctgggaaggggcgaggctcgccggcggtcggagcagcggggcgccagtcccggtcgctgtcgcgggcgggcgctggagaccgggacgccggcgctcggacggactgacttgctgaccgcccgccggaggcacaccccactccaccccaccccgcctcgccagcagcccggcgccggcgccgcctcccgcacgctactccctctgccaccccttccttctccacttcttttccgcctccgcctcttcttgtctcccgcggcgccagcgccttcccttggcccgggcgggggcctcggctccctgcagagctctccgtagtcagtgggggatatttcgttctagcggacaaccagcccctgagctgggcgagaggtgccaagggagcttctgtcccgaggaccaggggatgcgaagggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccaggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcattttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatgaagaacataaaa

SEQ ID NO: 4401 - DNA, 5549 bp, Homo sapiens
  ENST00000369499
ttagcttatcaggagaacttactgtaaaccgactctttttgtttcaaagatgtctcccactccaggcgaggagcgctcttggctgaggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccaggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcattttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatg

SEQ ID NO: 4402 - DNA, 2122 bp, Homo sapiens
  ENST00000549890
tcggcttatttgttttccctcctcttaggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttc

SEQ ID NO: 4403 - DNA, 1252 bp, Homo sapiens
  ENST00000362094
atgaagtcgatcctagatggccttgcagataccaccttccgcaccatcaccactgacctcctgtacgtgggctcaaatgacattcagtacgaagacatcaaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 4404 - DNA, 1320 bp, Homo sapiens
  ENST00000468898
atgaagtcgatcctagatggccttgcagataccaccttccgcaccatcaccactgacctcctgggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 4405 - DNA, 1550 bp, Homo sapiens
  ENST00000428600
cagttgcataaagaacatagatgagagctttcattccctgctgaaaaggatgccatgcctccaccagtgattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 4406 - DNA, 591 bp, Homo sapiens
  ENST00000551417
gcagagctctccgtagtcagtgggggatatttcgttctagcggacaaccagcccctgagctgggcgagaggtgccaagggagcttctgtcccgaggaccaggggatgcgaaggatgtctcccactccaggcgaggagcgctcttggctgagggcaaagagattgaaagaggggagtcacataatcagcatacgtttatgaagattacccccacagctgtgtggcaagtgatcaaaaaggaacaggaccagagaagagcaggaaaactggtcagaaagcaggcgccctaaccctggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacatt

SEQ ID NO: 4407 - DNA, 1910 bp, Homo sapiens
  ENST00000351266
gcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgag

SEQ ID NO: 4408 - DNA, 2052 bp, Homo sapiens
  ENST00000378980
ctgaagagccggtgcagagcgggcggcggcggcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgag

SEQ ID NO: 4409 - DNA, 921 bp, Homo sapiens
  ENST00000417345
gcacggggaccacagccgtcttgagggcgcgcccgagaaaggactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcat

SEQ ID NO: 4410 - DNA, 1926 bp, Homo sapiens
  ENST00000610543
ccggggctgcgcgtgaagcacggggaccacagccgtcttgagggcgcgcccgagaaaggactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatg

SEQ ID NO: 4411 - DNA, 4000 bp, Homo sapiens
  ENST00000640352
ggcaggcgggccagacagcgccccgcggcctgtccatgagcggcccatgcattatggaagacgcgcgctgggctcgctccctggtccttaaatgacagcaaatgaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcaggtgaagatactgaggctcagaagagttctataactttcccaaggtcccacagctagtagagggccagcctagtccccaggcccaggcctcgttggtccacactgccccagtaagggtattaggctccagggacacacatcctctctgcatgtttgtggctggcgacgtctcatgcacctcacaccccacagatcagttcttctgtaagggtcccttgaaagccccctgggaggtagaactgcttccattctgaggccccagcatcttgaactttatggcatttgctaccttgcactgtcaatttcctgtctccctccttggaccgcaagccccttgaagaagagggactgtgtcttaatcatctttacaagccagtctctagcccagtgctgggtatagagcaggtgctcaatacctaagtgtaggatgggtgattgattgaactagtatggccagatggggcctgcccagcctatttaaattcaaatttaaattaattaagtaatataaaatgtaaaatgtcgttcttcagtcgcaatagccacatgtcaagtgctcgatagccctacgtggctagtggttaccacattgaacagtgcagaaaatgggacattcccatcatcagagaaagttttactggacagcacagcccaagaggccaggctccagccaggccaaggctctgaggcatctggtggtgtcatcacctgcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctgtgagacccgcgggggaccaagacactttgggggagggggagagggggctaggagaaattactgagaaaggataagggacaccctcaagccgggccttcctgacctcacatgacatgccttagtgaactgctgcttctccgtgaaggatgagtcggggaggggctcgcaggccaggaggacagtgcctgagcccctggtctctgcctccagttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctcc

SEQ ID NO: 4412 - DNA, 4447 bp, Homo sapiens
  ENST00000638378
gtccatgagcggcccatgcattatggaagacgcgcgctgggctcgctccctggtccttaaatgacagcaaatgaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaag

SEQ ID NO: 4413 - DNA, 7999 bp, Homo sapiens
  ENST00000331830
gaggaccagagccagccagtgagcggagcctgggagagggaggagcacatcttgatgcagagatgctgcagtggctccgggcgcgctcacacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgagctctgggtatactaccagtcacagaacgtcagagctggaagaagccttagagctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggcactgctgaatggctatggcctggctaagaaggtgattagtcagtagggtgtgaaaattctacttcaaggggttcggattggtgatcatggggattggcatggctgggttcccgtccaaggtgtgggcagagcttctaccaaacttcaacatggagggctgacttgaagctccctgtccccctcactcttgccccaagaaaagaggccaaagcaagagcagattccctaggcaagagcagcagcacaactaggaaaccccaaagcccatgctccgacaggtggcccttcacagggggcagcgggacaggcatcttgaagggcatatgtcctcggaagctccgagcctgttttctgtagtttatagttagagctctattttgttatggttttttaaacttttaagtcctgctctattttcctgggcaggtttatgttgatgtttacccactacaattttttaaaaatataagctcacatgccttttccctgccacagccaaacccccactgcaccctacccacccacccctagcccaggtcagctttcctggagctggctaatgaaagcctcctcacctcttcccaacccttacaagcaagggtgctaggggctcagctatacgaccattctccctgacagggagtccaaacttggcctagcatccctcctggcccccctctggccacgacttggcctgtgcctggttctctatcagaaaggggatgctgaacaaaacctccttccaagttttatccaattcgttcctcattgcctcgggctgcgtcaggggaagcaggggacaggtgtccagttgctgggccgagggaggagctggtttggcataggacctaaccagtgaagctagaggctacagccactaaacttgcttcaggccaacgatagttactcacaagtaagtaccttaatgctaatgaggtccactaaaaaggggaggaaggcagacctcctgggagacccacgaagggtttttagccagggaaaactgagccccaggaaaacctaaccactgggcaggcagaatttgtttgagggatagaacgacaacaaaataaatgttcctgcagcctgagatttcaggtagagtactgactaaggtttaataagacaataggtgacctgaggacatgcaagcttgtaaaatgcaacagcctcctgctagagtgacttgtacatgagcttgcttgcagaagactagattagatgtttctcaggatcccctcctgcgcaggggttctctgattttcgtgttctctgcccagatgggctgggggagttgagagtgtgcttattttcactgcgatcatgagaccacagttctgggttatctcctctcatacatcaagccccagaggaggcggcaagaggaacagccacaaacaagtactttaccccacagcttagtggccagtaaacaccctggggactaggaaaaggaaccaactgtaggcacctctccagggcctagggagacaagtgtcctctcttctgcatacatttgggctccccttacagagccctttgccctggctctctggtccttgttgctctaacagtccagatgtacacccagcctcagggggaaggcagctctctccagacagagtctcagggcccagcaaggtcaggttatctgctttcattcagggcaacaaatgatacaaatggtgccagggagtggcaaggccatgggggtaggtgggggtgtctttttcttttcataaagtaacaacagacgagactgaggttaaacatcagaaaaaaacctctggaatgaccttcctcattccaggaggccctggaataaggaagaggcttctttctgagggagctttgaggaattttgacagctgttgacatgggatttgggaaaggtgaagctgtgactggaggggcaggagatggtccaagtgtccatccagagatgagactcttagaatcaaagtgttcagcccaggaagtcttggagatcccaccttctgtggccctgcaccttatgggaagccattaagggggctcatctaggaattctggttacagcccagtgctcatcccagcgtatgctgcctctttagggcagccccaagggccagccagcctgtactctgggcaagagcccaaaatggctaggaatgtttgactcccttaatctcttccccagctacagaggaatcttttctctgcctggtctcagaatgggactgccaactggctcattggtgggagacacagtatcctcaaacctgtggccactggcatgacagtggtgctctgtctccctgggtgacacccaccctaggcttcctcctggatgtgatggggattgccagagaggctcttagcataaaaggcattaggtgggcatttttctgtgtgcccccaaaaagctccatggaaacaggcacctggtagctgcggaacacccgtggacttgtgtatatggtcataggctttgggaagacaggacgtaaaggaaaatgagagaaacaaaatgggtcagatagctttggccacagccccaggcagcctttggggcctatgacacttagtgcccttagatgggatacatcttgcctcggccccaagactcctccaacttacccgtcccatccagggcctgcacagcttagagaggctcacagcttggcaaatgctagggcttcatcagaccactgacttgactcagtgtttgttaaaatggaaccactcccgttggcctactgtttctctcctgtacttcttgtaatgatagttatttattgactctggtagcaggcagttcttaaataaagatggtttctcaacctgttggggaagctggcacgagctgtgggtgttatcatcaggctaaagcatacctccttgtcctgttcttcactccagaggcttttatccaagaatttctttaccccccacacagtgaaatataagtaagttacaacatacagtctatattgcttcatccagtcccaggaggagggaaaaattaggccaagatcttaaggcaggtccaagcagagcacaggcaggcatttggctagaatcagttggctttacctaatacagtggcagtaaacaatgcttatgtga

SEQ ID NO: 4414 - DNA, 3733 bp, Homo sapiens
  ENST00000636809
agtggctccgggcgcgctcacacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctgtgagacccgcgggggaccaagacactttgggggagggggagagggggctaggagaaattactgagaaaggataagggacaccctcaagccgggccttcctgacctcacatgacatgccttagtgaactgctgcttctccgtgaaggatgagtcggggaggggctcgcaggccaggaggacagtgcctgagcccctggtctctgcctccagttctgcaggaattctccaaggaggagcgagacccagtgaaagctcatgaaggctggggggtgatgttgccctgtaacccacctgcccactacccaggtgagtccagacctggggccagggttagagagggcacaggaagggcttccagatgcttggcagaggaaggatggaataaaaggagacccctggaaatgacccttagaagcacccatccctgggaccctaactttaaatgatctgtgtttcctttataggtctgtcactttccatcgttgtgccctgcttccgccttcaaactgggtggcccctgagggctgcgatccctggcagacttagcgctccctgagggcaggaataaagtcacttcttccctctaggtctccccttagccccagttcagagcatggtggctgtcaggacagggcttgcagaaccgcaccagcatgctggggtcccacccagagtggccctgttagcccagcaccccctggtttcctcaaactcctcacatcctaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgaggtgagcaccaacctgggacttgggagaggaaggggtgctggggcttcaaagccaggtgggaacaactcacagaccactaatcattcctcctggcgtccctggttcgctgacatggcaaactgagcatccagtctgtgtagcactgtgaatgcaaatttcactaagaccccatggcaggccaggcgcggtggctcatgcctgtaatcccatcactttgggaggctgaggcggtagatctcctgagatcaggagtttgagaccagcctggcc

SEQ ID NO: 4415 - DNA, 4146 bp, Homo sapiens
  ENST00000640428
ggctccgggcgcgctcacacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggc

SEQ ID NO: 4416 - DNA, 1539 bp, Homo sapiens
  ENST00000532366
gggcgcgctcacacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcaggtgaagatactgaggctcagaagagttctataactttcccaaggtcccacagctagtagagggccagcctagtccccaggcccaggcctcgttggtccacactgccccagtaagggtattaggctccagggacacacatcctctctgcatgtttgtggctggcgacgtctcatgcacctcacaccccacagatcagttcttctgtaagggtcccttgaaagccccctgggaggtagaactgcttccattctgaggccccagcatcttgaactttatggcatttgctaccttgcactgtcaatttcctgtctccctccttggaccgcaagccccttgaagaagagggactgtgtcttaatcatctttacaagccagtctctagcccagtgctgggtatagagcaggtgctcaatacctaagtgtaggatgggtgattgattgaactagtatggccagatggggcctgcccagcctatttaaattcaaatttaaattaattaagtaatataaaatgtaaaatgtcgttcttcagtcgcaatagccacatgtcaagtgctcgatagccctacgtggctagtggttaccacattgaacagtgcagaaaatgggacattcccatcatcagagaaagttttactggacagcacagcccaagaggccaggctccagccaggccaaggctctgaggcatctggtggtgtcatcacctgcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtc

SEQ ID NO: 4417 - DNA, 4318 bp, Homo sapiens
  ENST00000639302
tcacacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggc

SEQ ID NO: 4418 - DNA, 4497 bp, Homo sapiens
  ENST00000639971
acacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaagg

SEQ ID NO: 4419 - DNA, 5081 bp, Homo sapiens
  ENST00000640326
acacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgagctctgggtatactaccagtcacagaacgtcagagctggaagaagccttagagctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggcactgctgaatggctatggcctggctaagaaggtgattagtcagtagggtgtgaaaattctacttcaaggggttcggattggtgatcatggggattggcatggctgggttcccgtccaaggtgtgggcagagcttctaccaaacttcaacatggagggctgacttgaagctccctgtccccctcactcttgccccaagaaaagaggccaaagcaagagcagattccctaggcaagagcagcagcacaactaggaaaccccaaagcccatgctccgacaggtggcccttcacagggggcagcgggacaggcatcttgaagggcatatgtcctcggaagctccgagcctgttttctgtagtttatagttagagctctattttgttatggttttttaaacttttaagtcctgctctattttcctgggcaggtttatgttgatgtttacccactacaattttttaaa

SEQ ID NO: 4420 - DNA, 2174 bp, Homo sapiens
  ENST00000639015
cgcttcggctgtgagacccgcgggggaccaagacactttgggggagggggagagggggctaggagaaattactgagaaaggataagggacaccctcaagccgggccttcctgacctcacatgacatgccttagtgaactgctgcttctccgtgaaggatgagtcggggaggggctcgcaggccaggaggacagtgcctgagcccctggtctctgcctccagttctgcaggaattctccaaggaggagcgagacccagtgaaagctcatgaaggctggggggtgatgttgccctgtaacccacctgcccactacccaggtgagtccagacctggggccagggttagagagggcacaggaagggcttccagatgcttggcagaggaaggatggaataaaaggagacccctggaaatgacccttagaagcacccatccctgggaccctaactttaaatgatctgtgtttcctttataggtctgtcactttccatcgttgtgccctgcttccgccttcaaactgggtggcccctgagggctgcgatccctggcagacttagcgctccctgagggcaggaataaagtcacttcttccctctaggtctccccttagccccagttcagagcatggtggctgtcaggacagggcttgcagaaccgcaccagcatgctggggtcccacccagagtggccctgttagcccagcaccccctggtttcctcaaactcctcacatcctaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaaggtcaggcttggccaggcgtggctggagggagggaactggaagggtcagcgggcattaggaaaagggtttttcctttggagattggaagatcagcttgcagggcactgattccaggccctggacccccagatcctcctgcttcaaatcctgaggcccttgccccaggcctcaaggagattccacacagctgcctagacagagttggctctgaaaggtgctgagatcccatgcacgggagcacctgacctggagtcatctgcatctgatttgtaaaaccctctctccccagatacccggctctttgcacccagcatcaaggcccggttcccagcagagacctatgcactggtggggcagcaggtcaccctggagtgcttcgcctttgggaagtgagtgtgaagagggaggggaagcagagcacggtctctcgggggcacaggtgaccccagggtgagggcaggcagagtcagggctcttatcttggtgtccctcacagggtctagcaaagtactgggcacacagtgggtatcgaccaccactcactggacagtacctctctgggtgaggcatcgcatatgccaggggccttccatggccaggatcacttggtcttccagcagtgcatggcaggctcagacagcttgagtaacacccagggctggaggcaggcagcacagtgtacagactccaaccctgtctgtctcattcagatcccagctctgccacccgcagaccttgggtaaactgcctaacctctctgtgcctcagtttctttatggtggtgataatagtacctacctcatagggttgtcatgaggattaaatcagttcatatatgtgagatacttagaacagtgcctggaatttagttaagtgttccgtgaatgttaacagtgatctatttgagaatggcagcagaaagtgttctctttctcgtactcctagaagaaggagtcactagaacagggctaagcaaatagcaggtgctcaataaatgtttgtagtatgaaagaaagaatgtgatttgtactttggccccctcctccctcaactatctcctatggttacctgggagaatctctgccttgtgggaagttttgggcttccagaaaatccacatgaaaagcatgtggaagtggggccaggtgcggtggttcatgtctgtaatcccagcactttgggaggccgaggtgggaagatcatgaggtcaggagatcgagaccatcc

SEQ ID NO: 4421 - DNA, 1238 bp, Homo sapiens
  ENST00000530117
tttgggggagggggagagggggctaggagaaattactgagaaaggataagggacaccctcaagccgggccttcctgacctcacatgacatgccttagtgaactgctgcttctccgtgaaggatgagtcggggaggggctcgcaggccaggaggacagtgcctgagcccctggtctctgcctccagttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccaggtaggagacatggggcttcccccgacacatcacaactgtcctctgctcacttggttccctcccccgcccagaacttcccctgcaccactagtagcccctctgggctaattagggtgtcagagggtggtcctaggaccacctaaggacttcttcccatcccagtcccattgtcacaggctaggcctggatccaggcacagttcagccacaaaagaagtgatgtggtcctgactgggtcacctcacccttccagctttggggaggcctgggtaatctgcatcctgaggttccaggcagccctgaggtaggactggacatataagccatatcctcta

SEQ ID NO: 4422 - DNA, 1548 bp, Homo sapiens
  ENST00000638928
agggacaccctcaagccgggccttcctgacctcacatgacatgccttagtgaactgctgcttctccgtgaaggatgagtcggggaggggctcgcaggccaggaggacagtgcctgagcccctggtctctgcctccagttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaagtgagtgtgaagagggaggggaagcagagcacggtctctcgggggcacaggtgaccccagggtgagggcaggcagagtcagggctcttatcttggtgtccctcacagggtctagcaaagtactgggcacacagtgggtatcgaccaccactcactggacagtacctctctgggtgaggcatcgcatatgccaggggccttccatggccaggatcacttggtcttccagcagtgcatggcaggctcagacagcttgagtaacacccagggctggaggcaggcagcacagtgtacagactccaaccctgtctgtctcattcagatcccagctctgccacccgcagaccttgggtaaactgcctaacctctctgtgcctcagtttctttatggtggtgataatagtacctacctcatagggttgtcatgaggattaaatcagttcatatatgtgagatacttagaacagtgcctggaatttagttaagtgttccgtgaatgttaacagtgatctatttgagaatggcagcagaaagtgttctctttctcgtactcctagaagaaggagtcactagaacagggctaagcaaatagcaggtgctcaataaatgtttgtagtatgaaagaaagaatgtgatttgtactttggccccctcctccctcaactatctcctatggttacctgggagaatctctgccttgtgggaagttttgggcttccagaaaatccacatgaaaagcatgtggaagtggggccaggtgcggtggttcatgtctgtaatcccagcactttgggaggccgaggtgggaagatcatgaggtcaggagatcgagaccatcctggctagcacggtgaaatccagtctctactaaaaatacaaaaaaaactagccaggtgtggtggcgggtgcctgtagtcccagctgctcgggaggctgaggcaggagaatggtgtgaacccgggaggcagagcttgcagtgagccaagattgccccactgcactccag

SEQ ID NO: 4423 - DNA, 3501 bp, Homo sapiens
  ENST00000639023
gctgcttctccgtgaaggatgagtcggggaggggctcgcaggccaggaggacagtgcctgagcccctggtctctgcctccagttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagac

SEQ ID NO: 4424 - DNA, 4306 bp, Homo sapiens
  ENST00000481872
gaaagctcatgaaggctggggggtgatgttgccctgtaacccacctgcccactacccaggtgagtccagacctggggccagggttagagagggcacaggaagggcttccagatgcttggcagaggaaggatggaataaaaggagacccctggaaatgacccttagaagcacccatccctgggaccctaactttaaatgatctgtgtttcctttataggtctgtcactttccatcgttgtgccctgcttccgccttcaaactgggtggcccctgagggctgcgatccctggcagacttagcgctccctgagggcaggaataaagtcacttcttccctctaggtctccccttagccccagttcagagcatggtggctgtcaggacagggcttgcagaaccgcaccagcatgctggggtcccacccagagtggccctgttagcccagcaccccctggtttcctcaaactcctcacatcctaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctg

SEQ ID NO: 4425 - DNA, 7112 bp, Homo sapiens
  ENST00000636312
cccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggtgctgctcctcccctacccttatcccctcgagagattcaggatccacccagatacctgagaggatcattcccacccaggccaactccaatctctacccgcaaaggaaagtggaaggcaggcaggaaccaagtgcaaagtagtcttagaactgcctcgccgccacctttctacccagcccccagaacatccccgagggccagggaagggcgcagggtgcagggggaggctgaggaccaaccagcaatagcaaacggcctacaaagcaccgtaggagtcggactgagaagaccacccagccgtccgctcccaggcctgcagctggccctgcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgagctctgggtatactaccagtcacagaacgtcagagctggaagaagccttagagctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggcactgctgaatggctatggcctggctaagaaggtgattagtcagtagggtgtgaaaattctacttcaaggggttcggattggtgatcatggggattggcatggctgggttcccgtccaaggtgtgggcagagcttctaccaaacttcaacatggagggctgacttgaagctccctgtccccctcactcttgccccaagaaaagaggccaaagcaagagcagattccctaggcaagagcagcagcacaactaggaaaccccaaagcccatgctccgacaggtggcccttcacagggggcagcgggacaggcatcttgaagggcatatgtcctcggaagctccgagcctgttttctgtagtttatagttagagctctattttgttatggttttttaaacttttaagtcctgctctattttcctgggcaggtttatgttgatgtttacccactacaattttttaaaaatataagctcacatgccttttccctgccacagccaaacccccactgcaccctacccacccacccctagcccaggtcagctttcctggagctggctaatgaaagcctcctcacctcttcccaacccttacaagcaagggtgctaggggctcagctatacgaccattctccctgacagggagtccaaacttggcctagcatccctcctggcccccctctggccacgacttggcctgtgcctggttctctatcagaaaggggatgctgaacaaaacctccttccaagttttatccaattcgttcctcattgcctcgggctgcgtcaggggaagcaggggacaggtgtccagttgctgggccgagggaggagctggtttggcataggacctaaccagtgaagctagaggctacagccactaaacttgcttcaggccaacgatagttactcacaagtaagtaccttaatgctaatgaggtccactaaaaaggggaggaaggcagacctcctgggagacccacgaagggtttttagccagggaaaactgagccccaggaaaacctaaccactgggcaggcagaatttgtttgagggatagaacgacaacaaaataaatgttcctgcagcctgagatttcaggtagagtactgactaaggtttaataagacaataggtgacctgaggacatgcaagcttgtaaaatgcaacagcctcctgctagagtgacttgtacatgagcttgcttgcagaagactagattagatgtttctcaggatcccctcctgcgcaggggttctctgattttcgtgttctctgcccagatgggctgggggagttgagagtgtgcttattttcactgcgatcatgagaccacagttctgggttatctcctctcatacatcaagccccagaggaggcggcaagaggaacagccacaaacaagtactttaccccacagcttagtggccagtaaacaccctggggactaggaaaaggaaccaactgtaggcacctctccagggcctagggagacaagtgtcctctcttctgcatacatttgggctccccttacagagccctttgccctggctctctggtccttgttgctctaacagtccagatgtacacccagcctcagggggaaggcagctctctccagacagagtctcagggcccagcaaggtcaggttatctgctttcattcagggcaacaaatgatacaaatggtgccagggagtggcaaggccatgggggtaggtgggggtgtctttttcttttcataaagtaacaacagacgagactgaggttaaacatcagaaaaaaacctctggaatgaccttcctcattccaggaggccctggaataaggaagaggcttctttctgagggagctttgaggaattttgacagctgttgacatgggatttgggaaaggtgaagctgtgactggaggggcaggagatggtccaagtgtccatccagagatgagactcttagaatcaaagtgttcagcccaggaagtcttggagatcccaccttctgtggccctgcaccttatgggaagccattaagggggctcatctaggaattctggttacagcccagtgctcatcccagcgtatgctgcctctttagggcagccccaagggccagccagcctgtactctgggcaagagcccaaaatggctaggaatgtttgactcccttaatctcttccccagctacagaggaatcttttctctgcctggtctcagaatgggactgccaactggctcattggtgggagacacagtatcctcaaacctgtggccactggcatgacagtggtgctctgtctccctgggtgacacccaccctaggcttcctcctggatgtgatggggattgccagagaggctcttagcataaaaggcattaggtgggcatttttctgtgtgcccccaaaaagctccatggaaacaggcacctggtagctgcggaacacccgtggacttgtgtatatggtcataggctttgggaagacaggacgtaaaggaaaatgagagaaacaaaatgggtcagatagctttggccacagccccaggcagcctttggggcctatgacacttagtgcccttagatgggatacatcttgcctcggccccaagactcctccaacttacccgtcccatccagggcctgcacagcttagagaggctcacagcttggcaaatgctagggcttcatcagaccactgacttgactcagtgtttgttaaaatggaaccactcccgttggcctactgtttctctcctgtacttcttgtaatgatagttatttattg

SEQ ID NO: 4426 - DNA, 1749 bp, Homo sapiens
  ENST00000639831
cagggcactgattccaggccctggacccccagatcctcctgcttcaaatcctgaggcccttgccccaggcctcaaggagattccacacagctgcctagacagagttggctctgaaaggtgctgagatcccatgcacgggagcacctgacctggagtcatctgcatctgatttgtaaaaccctctctccccagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaaggtaaggggcccagggaggcaggggacatcccaaggacatgcatatggtggctttcagagctctgagtttaggtgtttccaaacacacatgcacataccctgtggccattttccttggttttccaacagtttctaagtaggagaactcagagatttaagaaaggagatgagacacagggttgacagctgccagagggcagggtctctgacttgttccatgtctggcacacagtaaatgtttgctgcagtgagtgaaaaaaacagaaaccaaatcaatcagatttgtgtaacccaaccctttcagctatgtgagctttggcaagttacttagtgtttctgtgtttcagtttcttgattataaaatataggcaataatagtcctgccctcctgggctgctgtatggaacaagtgagatgaaagaggtacagcataaagggcctgcccaccatacagcaggtgcccgggaaatgtaagccagtgctaatatttagttgtgtgacttgagctcactgagcctcagtttcctcatccataaaatggacacagtgatacccaccacatcaggttttagtgaagctttgctaagaagcattcattcgttccttcatccattcaaccactacttactcaacacttcacagggatgaatataaaagatacggtctctgcctttaagtagcttacaatccagtagagggaaagggacaaataaaccccaaatcaaacaattaaataatttcagctagccatcaaatatagtataaagaaaatccaggcagggtgcagtggctcatgcctgtgtaatcccagcactttgggaggcaggggtgagtggatctcctcaagctcaggagtttgagaccagcctgggcaacatggtgaaaccccatgtctatgaaaaacacaaaatttagccaggcatggtagcacacacgtgtagtcccagctacacaggaggctgaggcaggagaatcacttgagccctggaggcagaggctgcagtgaactgagatt

SEQ ID NO: 4427 - DNA, 1082 bp, Homo sapiens
  ENST00000639503
attaaaactgatacctcagtccgttttagtgcacagattactactaactaaagtccctttcaaagtaggggcaaggcctgccctgtagaggcaacggaaaagagaacccgtaaagacccaggtcacaggccactgtggcggagggcagacccagaggcatggtgaccggtgcgggagagggcaggccagcttcagggtgcagaccccgcagaagcccggcttcactggctccagggttgttgcaggggggatgggtagagcagccctgcctcttgccccttccctgcgtgtgctccgagcctacctgggagaggagagtgaggatcagccagaaggcaccctctctccctctgttcctcccaggcccagcatctcaggagggcctgagagtctgggtatgaggagctgcgggcactggaggggtaggcccagctcagcccacaccctctggctttgtctctcctgccagccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagat

SEQ ID NO: 4428 - DNA, 3370 bp, Homo sapiens
  ENST00000639122
gatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggcca

SEQ ID NO: 4429 - DNA, 1436 bp, Homo sapiens
  ENST00000530594
ggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtgaggggtttcccacctctacccctaccccaactcccttaaaacccagctgggctgttctgacctgctcgcctcatctcccctcccttccctcaaagctgcggggaagggcttccggcggaactcctgtgagctggatataccctgtggttcttcacaggtcctaaatgatcaggacatttttcttccaaagtcaaagtttaaaaaatccactcctaaacacatcccaagacaggagtgctttactgagccctgaagttttcaaagcctagtgctgggagatctatgcacctctccatgtgacagcctctgtgagctcccccagccttgagacacatccctccacccaacaactggcacccgccccaactgcccacaccccttgcccgccctcccgcctgggtgtgtgttcactgcatcctctgctgccctgtctt

SEQ ID NO: 4430 - DNA, 1876 bp, Homo sapiens
  ENST00000638449
accgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaaggtgggctgcccctgggccccctgctcgtccctaccccagccacttgtccacagggatgtggggtgggggaacgctactcatctcccagctcagttccataggaggaggttgagaggacacctgggttccacatcattggcctcacttccagctcttgctaccttgtctcccttcggggttaggaaaagggaggctctctgggaatagaagtgggccctggagcattgcttggggggctcccactcggccttcatcctgaaggctttcctccaaaatcttaagcaaaggcaatcctggttgggggctgctctgcaggacacaggggggccctgggaatccaaacccattctgtattggtccccagagcccagggtggcccctaccaaggtg

SEQ ID NO: 4431 - DNA, 1789 bp, Homo sapiens
  ENST00000638980
ccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcaggtgagagtcctgtgtgtcccaaaaagctatcatcagggcagagaccctggcaccacttatagggaatgccaagccagccgcaattatgctgagttccaaccctgctcacagggttcagactctcacaaaacagaggaggacagaacaccaagttgggaccagggccactgcatggacaaaccatctagtccaaactcctcatttaaaaactggccaaccttacaactgcatgtgcatctataatttttttaagtttaatttttaaaagtggaaaaaccaaagttcggagaaaggaagagtcacattgacagagcttggacttgaacccaggaccatggggtggtagacagatgtcttcctggaagagtatgcactacagaaatcagttaatgctggctgggcgcagtggctcaagcctgtaatcccagcactttgggaggccgaggcaggcagatcacctgaggtcagaagtttgagaccagcctggccaacatggtgaaaccccgtctctactaaaaatacaaaaattagccaggcgtggtgacacacacctgtaaatcccagctactcgggaggctgaagcaggagaatcgcttgaacccgggaggtggaggttgcag

SEQ ID NO: 4432 - DNA, 2075 bp, Homo sapiens
  ENST00000639156
agcctgcttgccctaggactgcactgagtctgggaccagaggaggctagtgctgtggtcacctcagagcttcagtcaggggtgcagaaagcacacaggaggctccagaatgatttaagttgcaaaagcagccactggcacagccacagagtgccagctttcttgtgcctccttcttccggccccctcctctttgtcctctccatctcagaatgctcatggcgccctctgctgtctggcacaggtgctgctgccctgattttctgttccttttaatgagctggaagctcctcctagctcatgccaggttttcttttccgggctcccacagctcagcctgagtggctaaaagtgatctcggacacagaggctgacattggctccaacctgcgttggggctgtgcagccgccggcaagccccggcctacagtgcgctggctgcggaacggggagcctctggcctcccaggtaggagacatggggcttcccccgacacatcacaactgtcctctgctcacttggttccctcccccgcccagaacttcccctgcaccactagtagcccctctgggctaattagggtgtcagagggtggtcctaggaccacctaaggacttcttcccatcccagtcccattgtcacaggctaggcctggatccaggcacagttcagccacaaaagaagtgatgtggtcctgactgggtcacctcacccttccagctttggggaggcctgggtaatctgcatcctgaggttccaggcagccctgaggtaggactggacatataagccatatcctctagggattatcagcctagagtctccactgctcccacccctgccaacccctcctccctgtggctcctgtggtcctgatccccctgggctctgggctcttctgcacagaaccgggtggaggtgttggctggggacctgcggttctccaagctgagcctggaagactcgggcatgtaccagtgtgtggcagagaataagcacggtaccatctacgccagcgccgagctagccgtgcaaggtaaggggcccagggaggcaggggacatcccaaggacatgcatatggtggctttcagagctctgagtttaggtgtttccaaacacacatgcacataccctgtggccattttccttggttttccaacagtttctaagtaggagaactcagagatttaagaaaggagatgagacacagggttgacagctgccagagggcagggtctctgacttgttccatgtctggcacacagtaaatgtttgctgcagtgagtgaaaaaaacagaaaccaaatcaatcagatttgtgtaacccaaccctttcagctatgtgagctttggcaagttacttagtgtttctgtgtttcagtttcttgattataaaatataggcaataatagtcctgccctcctgggctgctgtatggaacaagtgagatgaaagaggtacagcataaagggcctgcccaccatacagcaggtgcccgggaaatgtaagccagtgctaatatttagttgtgtgacttgagctcactgagcctcagtttcctcatccataaaatggacacagtgatacccaccacatcaggttttagtgaagctttgctaagaagcattcattcgttccttcatccattcaaccactacttactcaacacttcacagggatgaatataaaagatacggtctctgcctttaagtagcttacaatccagtagagggaaagggacaaataaaccccaaatcaaacaattaaataatttcagctagccatcaaatatagtataaagaaaatccaggcagggtgcagtggctcatgcctgtgtaatcccagcactttgggaggcaggggtgagtggatctcctcaagctcaggagtttgagaccagcctgggcaacatggtgaaaccccatgtctatgaaaaacacaaaatttagccaggcatggtagcacacacgtgtagtcccagctacacaggaggctgaggcaggagaatcacttgagccctggaggcagaggctgcagtgaactgagattgtgccattgcactccagcctgggcaac

SEQ ID NO: 4433 - DNA, 555 bp, Homo sapiens
  ENST00000527340
atgccaggttttcttttccgggctcccacagctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagc

SEQ ID NO: 4434 - DNA, 4065 bp, Homo sapiens
  ENST00000525433
ggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataaggtgaggaagcaatcagctaggcccagaatgggaaggaacagctcctctgtgtttccagtgaacataagcagcagcaatttatagcaagaggcatctgagtgagacataagcaaagggtttgtgactgtgagaggaatgaaattcatgaactattctctcagtaacttgcagtagaaactataaaaacgggcagatggtatcactgcagaaaggcagagttcacaggggcagtgatggactatggggatggagtatgggggttcttctagcttaaggagtctacggaaacagttcagtggcctgcaagctttcctccaccaatgaggagctttgtcaatggggaggaggggtgaggaggctggacctcaagagcccagaaccatcgggtctcctcccagtacctaaagctggggatgactcaacgatcagccctggtgtcaggaaactccacctggaaacctccttcccacagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggtgctgctcctcccctacccttatcccctcgagagattcaggatccacccagatacctgagaggatcattcccacccaggccaactccaatctctacccgcaaaggaaagtggaaggcaggcaggaaccaagtgcaaagtagtcttagaactgcctcgccgccacctttctacccagcccccagaacatccccgagggccagggaagggcgcagggtgcagggggaggctgaggaccaaccagcaatagcaaacggcctacaaagcaccgtaggagtcggactgagaagaccacccagccgtccgctcccaggcctgcagctggccctgtgagtctccttaggaaaggtctcaatcttgccacaagggtggggctagggtagtcccaggcccagctgactcagcttgtgctggtttcaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggtta

SEQ ID NO: 4435 - DNA, 2957 bp, Homo sapiens
  ENST00000639843
gggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtcctaaatgatcaggacatttttcttccaaagtcaaagtttaaaaaatccactcctaaacacatcccaagacaggagtgctttactgagccctgaagttttcaaagcctagtgctgggagatctatgcacctctccatgtgacagcctctgtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaagg

SEQ ID NO: 4436 - DNA, 876 bp, Homo sapiens
  ENST00000636641
gccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagcatcccagtagctgaggagcacaaagacagctgtgatgcaaaggaaacatgatgggctttaaaatgagaagggctgagttcagattctacctgtgccatgtattaactgtgtgaccttaggcaagttgattaactgctctgggcctcagtctttccaccctgaaaagggcaataataacacccacctcacaggatcaaatggccaatgtgtttaagtacctcttgcaaattacacggtcctaaactattgtcatcagaagcaagtgaaaaatctccagctgctggattctctacggaaatattttgacccccagccaagttactttctgccaagctgca

SEQ ID NO: 4437 - DNA, 2840 bp, Homo sapiens
  ENST00000638577
ggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggtgctgctcctcccctacccttatcccctcgagagattcaggatccacccagatacctgagaggatcattcccacccaggccaactccaatctctacccgcaaaggaaagtggaaggcaggcaggaaccaagtgcaaagtagtcttagaactgcctcgccgccacctttctacccagcccccagaacatccccgagggccagggaagggcgcagggtgcagggggaggctgaggaccaaccagcaatagcaaacggcctacaaagcaccgtaggagtcggactgagaagaccacccagccgtccgctcccaggcctgcagctggccctgtgagtctccttaggaaaggtctcaatcttgccacaagggtggggctagggtagtcccaggcccagctgactcagcttgtgctggtttcaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcag

SEQ ID NO: 4438 - DNA, 2903 bp, Homo sapiens
  ENST00000638715
tgtaccagctcaagcctggctgggaggaggttggctcaaattggaagctgcccaattctgacccactgtgctctgacctcttggtgcaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggtgctgctcctcccctacccttatcccctcgagagattcaggatccacccagatacctgagaggatcattcccacccaggccaactccaatctctacccgcaaaggaaagtggaaggcaggcaggaaccaagtgcaaagtagtcttagaactgcctcgccgccacctttctacccagcccccagaacatccccgagggccagggaagggcgcagggtgcagggggaggctgaggaccaaccagcaatagcaaacggcctacaaagcaccgtaggagtcggactgagaagaccacccagccgtccgctcccaggcctgcagctggccctgcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggc

SEQ ID NO: 4439 - DNA, 2981 bp, Homo sapiens
  ENST00000639788
ggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataaggtgaggaagcaatcagctaggcccagaatgggaaggaacagctcctctgtgtttccagtgaacataagcagcagcaatttatagcaagaggcatctgagtgagacataagcaaagggtttgtgactgtgagaggaatgaaattcatgaactattctctcagtaacttgcagtagaaactataaaaacgggcagatggtatcactgcagaaaggcagagttcacaggggcagtgatggactatggggatggagtatgggggttcttctagcttaaggagtctacggaaacagttcagtggcctgcaagctttcctccaccaatgaggagctttgtcaatggggaggaggggtgaggaggctggacctcaagagcccagaaccatcgggtctcctcccagtacctaaagctggggatgactcaacgatcagccctggtgtcaggaaactccacctggaaacctccttcccacagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgagctctgggtatactaccagtcacagaacgtcagagctggaagaagccttagagctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggc

SEQ ID NO: 4440 - DNA, 1048 bp, Homo sapiens
  ENST00000638050
caagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaaggtgggctgcccctgggccccctgctcgtccctaccccagccacttgtccacagggatgtggggtgggggaacgctactcatctcccagctcagttccataggaggaggttgagaggacacctgggttccacatcattggcctcacttccagctcttgctaccttgtctcccttcggggttaggaaaagggaggctctctgggaatagaagtgggccctggagcattgcttggggggctcccactcggccttcatcctgaaggctttcctccaaaatcttaagcaaaggcaatcctggttgggggctgctctgcaggacacaggggggccctgggaatccaaacccattctgtattggtccccagagcccagggtggcccctaccaaggtgtgggccaaaggggtctcatcctcagagatgaacgtgacctgggaacccgtgcagcaggacatgaatggtatcctcctggggtatgaggtgagcaccaacctgggacttgggagaggaaggggtgctggggcttcaaagccaggtgggaacaactcacagaccactaatcattcctcctggcgtccctggttcgctgacatggcaaactgagcatc

SEQ ID NO: 4441 - DNA, 2798 bp, Homo sapiens
  ENST00000639354
ggagcagatggaattgaataacctgcccacaaccctcagcaaaaagcgtgtgggtgtcagaacttgagtggagaaggagggggagaaaagaacccaggagagagtaggggaggcacaggctccagtcagcatctgctgagaggctcctgcccatctccgagccattcgcaggggaaggcctggaatgagagcccggggatcctgggaccaggagcatagattaaggaccctgcctcacctcctctacagacctgttgcactggatgtgtagtgagggtccaccttcttgtctgcctgaaacatgttctcctacatgccccagactgactctccaggccctttttctagaatcactcaacatttttagctggtacctctcctgagtaagaaattccagaggcagcactttctttgattgatcctgaacttcttggagggtcaaatgtggagaaatgaggggactcctttattctatttacagcatcccagtagctgaggagcacaaagacagctgtgatgcaaaggaaacatgatgggctttaaaatgagaagggctgagttcagattctacctgtgccatgtattaactgtgtgaccttaggcaagttgattaactgctctgggcctcagtctttccaccctgaaaagggcaataataacacccacctcacaggatcaaatggccaatgtgtttaagtacctcttgcaaattacacggtcctaaactattgtcatcagaagcaagtgaaaaatctccagctgctggattctctacggaaatattttgacccccagccaagttactttctgccaagctgcaggagctgatgaaataaattcctgttttaatatcagccttgtttaatactagagacaattaggagattaaatctgcaacaaaaagaaaaatagataatatatcaccctggagcccaaaagtagtttgttttgtttgtttgtttgtttgtttgtttgtttgtttgtttgcattaactgcagttctgggttatttattccccttattttaaagcgagtgagagttggtctctgtgatttagtttaagttgatggagtaaggaggacaatgatcatgtgtgcatcatctgctctatactaaccaccgtcttgtctaatttcattctcattatggcctctgagagaaacatgattatcttcatggagaagagaatcagaggctcagaaaggttaagtgacttgcccagggaagcacagctagtaaatggcagaggtgggatttgatttcaggactgcctgactccaaagcctatgttcagagggaccactggggggcaaacccagggcccagttgaaggggttcccatcttacggtgctctacaggcacaggctcagggctttcattttttccttgctcattaacaagccatatcggtgtcccttggcccttgacagccccctcggtggcaccctcaggactcagcggaggaggtggagcccccggagagctcatcgtcaactggacggtaagctgcaagggtcagatgtcctcctcctcctccctgacccctctcccgcttgagcagctgcagaaaggaccactgcacagctctgactcaaacgcggataacttcctgtcccccttccacgcacccgctgccccttacgcgaatccacgctgcaggcgtaggcgtccagggccgctactcttggcaaaggttgggtggggccagggaacgggcagggacacatgccgcggaccctcgcccatgccatgctcttgcccctcagcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaaggtgggctgcccctgggccccctgctcgtccctaccccagccacttgtccacagggatgtggggtgggggaacgctactcatctcccagctcagttccataggaggaggttgagaggacacctgggttccacatcattggcctcacttccagctcttgctaccttgtctcccttcggggttaggaaaagggaggctctctgggaatagaagtgggccctggagcattgcttggggggctcccactcggccttcatcctgaaggctttcctccaaaatcttaagcaaaggcaatcctggttgggggctgctctgcaggacacaggggggccctgggaatccaaacccattctgtattggtccccagagcccagggtggcccctaccaaggtgtgggccaaaggggtctcatcctcagagatgaacgtgacctgggaacccgtgcagcaggacatgaatggtatcctcctggggtatgaggtgagcaccaacctgggacttgggagaggaaggggtgctggggcttcaaagccaggtgggaacaactcacagaccactaatcattcctcctggcgtccctggttcgctgacatggcaaactgagcatccagtctgtgtagcactgtgaatgcaaatttcactaagaccccatggcaggccaggcgcggtggctcatgcctgtaatcccatcactttgggaggctgaggcggtagatctcctgagatcaggagtttgagaccagcctggccaacatggtgaagccccgcctctactaaaaatacaaaaattagctgggc

SEQ ID NO: 4442 - DNA, 2610 bp, Homo sapiens
  ENST00000640227
aaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccgtgagtctgtctgcctggggtgggggtagggcaatattttggagggtgggtgcctctgagatcattccttccccaatgataagacaaatgctctagcccaccagctctgggctgaacagaaattaggcagcgagcctaatggaaataagggaatggaattcatggcccctgaagcgtctcacacttctccaacctttggattttcatgggctttgtttcgtgggcatgacagaatgtgctgggtgtaactgctagaggcaaacatccagagaagggctggttaaaggtgagggggtgcggggtgccagggaaacgtttggacatctctccaattcttcctctctggcagctccgcggcgacctcctggcaacatctcctggactttctcaagctctagtcttagcattaagtgggaccctgtggtccctttccgaaatgagtctgcagtcaccggctataaggtgaggaagcaatcagctaggcccagaatgggaaggaacagctcctctgtgtttccagtgaacataagcagcagcaatttatagcaagaggcatctgagtgagacataagcaaagggtttgtgactgtgagaggaatgaaattcatgaactattctctcagtaacttgcagtagaaactataaaaacgggcagatggtatcactgcagaaaggcagagttcacaggggcagtgatggactatggggatggagtatgggggttcttctagcttaaggagtctacggaaacagttcagtggcctgcaagctttcctccaccaatgaggagctttgtcaatggggaggaggggtgaggaggctggacctcaagagcccagaaccatcgggtctcctcccagtacctaaagctggggatgactcaacgatcagccctggtgtcaggaaactccacctggaaacctccttcccacagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtatt

SEQ ID NO: 4443 - DNA, 633 bp, Homo sapiens
  ENST00000640714
cagtacctaaagctggggatgactcaacgatcagccctggtgtcaggaaactccacctggaaacctccttcccacagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaa

SEQ ID NO: 4444 - DNA, 4948 bp, Homo sapiens
  ENST00000263665
gagttactcttgcatttggcaattaaagatgatgtttccatggaaacagttgatcctgctttcattcattggctgcttaggaggtgagcttctcttacaaggccctgtatttatcaaagaacccagcaacagcattttccctgttggttcagaagataaaaaaataactttgcattgtgaagcaagaggcaatccatcacctcattacagatggcagctgaatggaagtgatattgatatgagtatggaacatcgttataagttgaatggaggaaatcttgtggttattaatcccaacagaaattgggatacaggaacttaccaatgttttgcaacaaattcacttggaacaattgtcagcagagaagccaaacttcagtttgcctatcttgaaaattttaaaaccaaaatgaggagtacagtgtctgtgcgtgaaggccagggagttgtgctgctctgcggccccccaccacactctggagaactgtcatatgcttggatcttcaatgaatacccatcgtttgttgaagaagatagtcggagatttgtctcccaggagacagggcacctctacatatctaaggtggagccgtctgatgtgggaaattacacatgtgtggtgacaagtatggtgacaaatgcccgagtgctgggctctccaactcctttggtgctacgttctgatggtgtgatgggtgaatatgaacctaaaatagaagttcagtttccagaaactcttccagcagctaaaggttcgactgtgaaattggaatgttttgcccttggaaatcccatacctcagattaattggagaagaagtgatgggctgccattttccagcaaaattaaattaaggaagttcagtggtgtgcttgaaatccccaacttccaacaggaagatgcaggttcctatgaatgcattgctgagaattcacgaggaaaaaatgttgccagagggcgtctcacttactatgcaaagccccattgggttcaactcataaaggatgtggaaatagccgtggaggacagtctttattgggaatgcagggcaagcggcaagcccaagccttcctaccgatggctgaaaaatggagcagccctggtgctagaggagagaacacagatagaaaatggtgcccttacaatatcaaacctaagtgtgactgattctggcatgttccaatgcatagcagaaaacaaacatggccttgtttattccagtgctgagctcaaagttgttgcttctgctccagatttttcaaagaatccaatgaagaagttggttcaggtgcaggtgggcagcctggtcagcttggattgtaaacccagagcctccccaagggcactctcttcctggaagaagggggatgtgagcgtgcaggagcatgaaagaatttctttgttaaacgatggaggactcaaaatagccaatgtgactaaagctgatgctggaacttacacctgcatggcagaaaaccagtttgggaaagcaaatggcacaacacatttggttgttacggaaccaacaagaataactttggcaccatctaacatggatgtttctgttggtgaaagcgtcatattgccctgccaggtacaacatgacccgctgttagacatcatctttacctggtatttcaatggggcccttgcagattttaagaaagatggatctcactttgagaaagttggtgggagttcatctggtgatttaatgatcagaaacattcagctgaaacacagtgggaaatatgtttgtatggtgcaaacgggggtggacagtgtttcatctgctgctgacctcatagtaagaggttcacctggaccaccagaaaatgtgaaggtagatgaaattacagacacaacagcccaactctcttggaaagaaggtaaagacaaccatagcccagttatatcctattctatccaggctcggacacctttctccgtgggttggcaaaccgtcacaacagtgcctgaggtcatcgatgggaagacgcacacagccactgtagttgagttaaacccatgggtggaatatgaatttcgggttgtagccagtaacaaaattggaggtggagaaccaagtttaccctcagaaaaagtaagaactgaagaggcagttccagaagtgcctccttctgaagtcaatggaggaggcggaagccggtctgaacttgtgataacctgggatccagtccctgaagaactacagaatggtgaaggttttgggtatgttgttgctttccgccctcttggggttaccacctggatccagacagtggtgacatcccctgacaccccaagatatgtctttaggaatgaaagcatcgtgccatattcaccatatgaagttaaagtgggtgtttataataacaaaggtgaaggaccatttagcccagtgacaacagtgttctctgcagaagaagagcctacagtggccccatctcaagtctctgcaaatagcctatcttcctcagaaattgaggtttcatggaacaccattccttggaagttgagcaatggacatttactgggctatgaggtgcggtactggaatgggggtggaaaggaggaatcatccagtaagatgaaagtggcaggaaatgagacatcagccagactacggggcctgaagagcaacctggcctattacacggctgtccgggcttacaacagtgccggcgctgggccttttagcgccacagttaatgtaaccaccaagaaaacgcctcccagtcagccaccaggaaatgttgtttggaatgccacagacactaaagtgttacttaattgggagcaagttaaagccatggagaatgagtcagaagtaacaggatataaagttttctataggactagcagtcaaaataacgtacaagtactgaacacaaataaaacttcagctgaacttgtgctgcccattaaagaggactacattattgaagtcaaggccacaacagatggaggggatgggaccagtagtgaacagatcaggattccacgaataaccagtatggatgcaagaggatccacttcagccatctcgaatgtccaccctatgtcaagttatatgcctatagtactgttcttaattgtatatgtcctgtggtgatattaactcctttttattatttattggaaagttatttggttaccaaaaaaagtgctttcatgaaatgcagtgattatgcatgtttttttcaactcttatttttaactttctacttcattataggtaaatatgaatataattaaaaaaacagtaaatccttttaggggaatctgaaatgccttaatattaacttgataaaccaaaggaatttacatattacatacttcagacttttgatataaatgttcttaaactatgagtttaagcactgcctatggataaagactcacacactctcacatgtacacacacacgcatgagaatttctttttacattgaaaaactctttcatttaattcaaatgctattttcccattataatagcattatttggaagacttaaccagtatcaatttgaaatgctgatttaagtccccaaggatgaaaaatacattttaaaaattattttgttggagaggagtggcatgtgattcaaaagagcattgttggaaaatgctactgtggggcttagaagaatgatgtttggtttggtatgctgctaactagttgtaagactttacaaatcactttgccatctgtacctctcaattattcctctataaaatatggagataataatacctatctgatcagactttgccccatgaattagtttttaaaagataaagactgaagtatgaaagtgcttttgtcaccccaaatgcaattgacccatgcaaaatattagcatgaatttatttaatcacataaaagtcatgaagaccagccagattttcaagcttcattctgtttcattcagttatattccaaaattcaaatgatcacattttattctttctcaaaaaaaaaaagtttttttaaattaaaaaaggaattgtttccttcacagctatgaataagctttcaggttttattaaaacctagaggaaaaaatcaggaatgacctgaatctcaacccaaatattaaacaaaatccacataatccctcatttcaatttccaattccattaagggaccctctctttttggatggcagagatggttttttaatgaaatcccaccatctatctgagtgagtctggcaggctttttagttcctgagttaaatttgtaatagaaccaaggcaatgctgctgactttgatatgtatgactcagtctttcaatatgtggttttcaaaaaattgttgaagacgtgacttcatagcaatatatagagaataaattaaaatcagcagattgagttttcaacattgcaaaatcagttttttacctctttcctaccaatttcacattttgcagaaacttgttcacatttccaacaatatcagaattagaaaacagttcagataacaagaaagattaaaaattagggaaattctgatatcaccataaagcactattttacatttagagattacatttaagataaagtcatcatacacaaaaacaataaatatttataactttctctataaggtccgcatatactgtatatattgaaacaatctgaatgactagtagatttcatatgaccattgttatttccactttctccaatacttgtattttatgctacatgtaatgaagttggacctttttattatttagtaattcctatatgttcctatacttttcattttcaagatgattgctctattgtttcatgttgtttctagcaatatatctccatgagatatgcactttgtttcatattgaaaagtataaaatttatctttcaattcctgtgtgtgtatcctatggttatctgtatgtattattttctattctaataaaatttataacaagcaaa

SEQ ID NO: 4445 - DNA, 560 bp, Homo sapiens
  ENST00000477856
tatactctgttatttttttctgatttcatctattacaccaagcattaccaaaggcatcccgttctacttccactagcttcctatgatagccgccatctcctccgtgtaaaatatcacttgtacttcgatctgttttaaaatttctcattttgcatttcaagctcccagtcagccaccaggaaatgttgtttggaatgccacagacactaaagtgttacttaattgggagcaagttaaagccatggagaatgagtcagaagtaacaggatataaagttttctataggactagcagtcaaaataacgtacaagtactgaacacaaataaaacttcagctgaacttgtgctgcccattaaagaggactacattattgaagtcaaggccacaacagatggaggggatgggaccagtagtgaacagatcaggattccacgaataaccagtatggatgcaagaggatccacttcagccatctcgaatgtccaccctatgtcaagttatatgcctatagtactgttcttaattgtatatgtcctgtggtgatattaactccttttta

SEQ ID NO: 4446 - DNA, 658 bp, Homo sapiens
  ENST00000422330
agccgccgcgagcgccgggagggagggcagcgccgcgccagacggagcccggggttcgacgccaggattggctgcaagtagggagctttcgccgccgccccgggcccctcggactgtgccggcgccgcacccgaggctctcgccagcccggcgccccggtgctgaggaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagctt

SEQ ID NO: 4447 - DNA, 3057 bp, Homo sapiens
  ENST00000427741
gttcgacgccaggattggctgcaagtagggagctttcgccgccgccccgggcccctcggactgtgccggcgccgcacccgaggctctcgccagcccggcgccccggtgctgagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatgtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatg

SEQ ID NO: 4448 - DNA, 566 bp, Homo sapiens
  ENST00000455083
aagtagggagctttcgccgccgccccgggcccctcggactgtgccggcgccgcacccgaggctctcgccagcccggcgccccggtgctgagtgggtgaaaaagaacagtgtgtcatgaagacaggcacctggaggtgatttgggtggcattcatgagaaaattcacgttacccacttcgctaactgatgaaacactgccagagcccacttggactgtttcgcaactttacttaagggaataaaagctctcatgctgaggaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaa

SEQ ID NO: 4449 - DNA, 5093 bp, Homo sapiens
  ENST00000418658
ctgtgccggcgccgcacccgaggctctcgccagcccggcgccccggtgctgagtgggtgaaaaagaacagtgtgtcatgaagacaggcacctggaggtgatttgggtggcattcatgagaaaattcacgttacccgaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatt

SEQ ID NO: 4450 - DNA, 551 bp, Homo sapiens
  ENST00000490876
gtgccggcgccgcacccgaggctctcgccagcccggcgccccggtgctgagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaacttctggggggtttccagtttctttcgagaggcaagacaaccgccccgtcccctccccgggccc

SEQ ID NO: 4451 - DNA, 5198 bp, Homo sapiens
  ENST00000397461
gccattctcccgcctcagcctcccgagtagctgggactacaggcgccgccaccacgcctggctaatttttgtatttttagtagagacggggtttcaccgtgttagccaggatggtctcgatctcctgacctcgtgatccgcccgcctcggcctcccaaagtgctgggatgacaggcgtgagccaccgtgcccggcctggctctgtttttattagaaaaattctcaatcgtcgtcttttaagaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatt

SEQ ID NO: 4452 - DNA, 2463 bp, Homo sapiens
  ENST00000438282
ggttcgatgcgaggagagccagttagagatgtgtgtgattctcccagtgtgcgtctttgattcgtgtgctaattatgtcgatcctttggggaacacagccaggaagctgggtcctccttgatgaatgctggcggagagccatgcagcgcgcagcggagagcagttcagcatctctagtcccagctgagaatatggtcccattatctcccagctgcctaagcaatccataagggcctgttctgcgtggatgatcagtgtagtggaagcagggacttgctgagagctgaaatctctgtttgatttgctgtaacatgtaaagcgaaactgggacattttactttacagtctattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgagaattatagccattgtatctcttatagtattgtaacgaatgttatcttcaatcctttaattaaatttctttcaagtctctatagatttgaaattcatgtctaggaacactattccaacaaattaaaaactcaagactcatgtactatttttagaaaacattgtttaaacaatgacattggtaatttttaagatagctgtcccatttattcagagatatggatatggcttattatactaatagaaggctttgatcacctctatgctttgccttagtcacccagccaaccttgtcagttttaaggaaataaaattccc

SEQ ID NO: 4453 - DNA, 2637 bp, Homo sapiens
  ENST00000430505
ctgcgtggatgatcagtgtagtggaagcagggacttgctgagagctgaaatctctgtttgatttgctgtaacatgtaaagcgaaactgggacattttactttacagtctattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagt

SEQ ID NO: 4454 - DNA, 528 bp, Homo sapiens
  ENST00000434053
gaaactgggacattttactttacagtctattaaaggttatacaaaacttaaaagaagcagcaattctattcgcttgttattggacttgaaactccctttgacctcggaaactgaagatgaggttgccatgggaactgctggtactgcaatcattcattttgtgccttgcaggttcacagactgacttctggtccttgctgggggtgctgccagccttggaggctgatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgctt

SEQ ID NO: 4455 - DNA, 575 bp, Homo sapiens
  ENST00000480113
acaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctgga

SEQ ID NO: 4456 - DNA, 568 bp, Homo sapiens
  ENST00000473058
tttgagcattactcaatacatgttacatagtgcctgacacctgattagcaaactataaatgcttagcccttgacttaaagagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatg

SEQ ID NO: 4457 - DNA, 565 bp, Homo sapiens
  ENST00000473173
taagcatgcaggtatttttgagtacttttattaataaatcttacaaatttttctgcagtatacttccaaagagataatttaattttcctgatgactagcacttcatccccttctcctttttttccttaagactaccttaaaacaatacttttgaggggcaaagttgtatgcatggagaatttaatccaggcaaatggtgtggttctgcgacacaaatttttctgtagcagtaactgggagaagagccacaattcatgactgctggagataggacctgctttaaatgaaggaattaattgtgcacataatgatgtgtataagcattctgcattaacagaaaaatgagttttacattttatacattttaaaagaatctccaagacttagcccctttatttattcacaggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaag

SEQ ID NO: 4458 - DNA, 2322 bp, Homo sapiens
  ENST00000397459
gttctatgttcccagtgggaacataccagatggaggctttgatttgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttcttt

SEQ ID NO: 4459 - DNA, 726 bp, Homo sapiens
  ENST00000473845
aatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagta

SEQ ID NO: 4460 - DNA, 614 bp, Homo sapiens
  ENST00000475817
gatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagaattacatccaggctgtattcaatccatatctacatctgtatcttaactgtgtatgtatctgttctcagatctgtaaataaatatccttatcacaaa

SEQ ID NO: 4461 - DNA, 3064 bp, Homo sapiens
  ENST00000484686
gaggatcttcagccaagatggtttttcttccttcagtgagatcttttgtctatttggcaatggaagaagattagtattagaggatacgtgttggaaatgtggtttttcaggagaccgatgtccagtgtttttttttttacaatcatttccaaccatttcagagctgggtctgccccatcaaagagcaagctctggactgcagatcctcattacgttttcaaccctgtccagtacatcataactgtttaagatagactgactgcaagccctaaatttaaaagactgttaacaaaacgccaaataagatgggtggagaaggatgtagacaagaatgttacaagggaaacaaaaacgatttttgcatttgagtgaaactactgtgatttctgaagaccaccttccttctttcccagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatt

SEQ ID NO: 4462 - DNA, 4980 bp, Homo sapiens
  ENST00000427331
agtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgt

SEQ ID NO: 4463 - DNA, 572 bp, Homo sapiens
  ENST00000525047
cagccgcaggaggcgccgcacctacttcccaatataaccaactacggcgtgggggagcggaactgcgagaaggcggcagccaaagtgccattaaagctcggggcggagaggatgcgttacctgggtcccgtctgctgcgagaggcagggcaagctggaggattccctctgaatgattaagaactccgcaattcgcctctgccacaggctgcaaaggacccgaggaaccgctctctctgaactgtgctgatgggcaggaggatgggagacaggaattgagagtcacagaggaaggacagtggagtctggcatcttattgtcatctctaggtatccatggaagattgcttccaggaccctccccagcaatggaaaccaaactcaggagaagttcaagtactccagtcagcctttcacatccatggtttctgcatccacagttgggtgaatccacagatgtgtaacccgtagctaccactggctgactgcacttgacttatatatatttgggctcctgtatatccctattgtcaattgtctatacagcactggtaaaaaaaggactgaaaatcaa

SEQ ID NO: 4464 - DNA, 3144 bp, Homo sapiens
  ENST00000528727
acttcccaatataaccaactacggcgtgggggagcggaactgcgagaaggcggcagccaaagtgccattaaagctcggggcggagaggatgcgttacctgggtcccgtctgctgcgagaggcagggcaagctggaggattccctctgaatgattaagaactccgcaattcgcctctgccacaggctgcaaaggacccgaggaaccgctctctctgaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggtgagtatgctaatagtgcagtctgaagacatgatcaccataaattatcatacaaaggaatttaaatgcatggactttgagcacatcagtactgtgcattttactttcaattttacaatatatgttattttcgcttaaccttttgcctttgaaaaaattacatggaaaactcctccttagtaacagatgaaaaccaccaaactaacttcagagtccaaaacacctttagtagtaagttgtcactaagtgtttaacctaatgccaaggaaataatctaaacagttgagctactaagtcacttggactacagagataaaatttgtgtgtgtgtatatatgttttgcaaatgaaaagctagtggaacccccaggcatttttttcttctactacttctaagttgggcttccaaaaacagaaaaactgcatgtgtaagatggtggcatttgcaattgttaagtgacaaggatttttttaaagtctgaaaatgtcaacatacaacctctctatgcagaaatgacagttaaatggtttccagttatgaaacagtacaccaaattctgcaatcctaggaagctacatcttaagcaaatgactagagcacccatttcctttagcacagtattccacagtatggg

SEQ ID NO: 4465 - DNA, 4303 bp, Homo sapiens
  ENST00000527185
aattcgcctctgccacaggctgcaaaggacccgaggaaccgctctctctgaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggtatgaacagaatgattgaaaataagccttattgtttcttctgacatcacattctcctaaagagaggttttggtgacacctcagaatttcaacagaatttcttagaaattttgctctatgttaaagaaactaagaaatactattttactgggatgtgttatgttgctcattaactggtttatttttcagtacagtagcttccgtagcactatgcaaagatgtttttaaaagatgaaatagagttttagacaaaagcaggagctacaggtagatatttaattgtatccaatttactggtcattttaaaagtttttgtgtcttcctttctaataatttaatgtataaatacaagttttccttttgtactttattggtatctcttaccctcagtgctgaattatcaaattttgcttggaatttaatgatctgtattgtatctatgtattcagatagtttttttggtcccttaaatgttgctatttttaaacatagttattccagccttataatggtgaacatttcatatcaaatgaataacatcaatgaaattttagcctccgcagagaatagcagattgtgagtagtctgtgaacatgaatattttatgataacaaggtttggcttctcacacagctcttgttcttgttcttgccttgcttggccagtcatggagaggaattagggggataatgtctaaaagaaaaaaagaattagcatctgacccaagactttagttgcatttaaaaaaatttattcttacttttcctctgcttcagttcccattaagagaaaatcatcttgtgtcttgaacaatgatcaagtataggacttgtatactaacatggtttccaggctgaaacatatttttaattctatttgagttttcaaataatgcccaacaattatttgattaacatacagctggcattaaataatgatttctatgataaaaaaatttatacaatctttctaagagttacagcaagaacaatttatgggaaaccattacctacttatacaatatcatggacttatttctacaatcttgcttcaattaattatttggaatgataatttagtatctcattatgattgcatgtttaatgtgatgaatatttctgtttctcccaatccatgcttcagggaccatgtttgttcatcattaaatctcagcaaatgataatatatatatttggcccataactgaccacaataaatatgttgaatgaataaa

SEQ ID NO: 4466 - DNA, 3800 bp, Homo sapiens
  ENST00000528682
gaactgtgctgatgggcaggaggatgggagacaggaattgagagtcacagaggaaggacagtggagtctggcatcttattgggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatt

SEQ ID NO: 4467 - DNA, 6258 bp, Homo sapiens
  ENST00000524871
gaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 4468 - DNA, 3679 bp, Homo sapiens
  ENST00000418526
aaacagggcactctttaatgaagaaacaccagagctgttaaacacattgagacacagaagattctagtgactgaggatggcttcctcttggaaactaatgctgtttctgtcagtcaccatgtgtctttcagaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagata

SEQ ID NO: 4469 - DNA, 246 bp, Homo sapiens
  ENST00000530458
gcactctttaatgaagaaacaccagagctgttaaacacattgagacacagaagattctagtgactgaggatggcttcctcttggaaactaatgctgtttctgtcagtcaccatgtgtctttcagcattactgtcttccctgctgatctcagttgtttctcttttatcttctcaatgtcattttcctcttgaacttataagccaactgaaggagatggaggtagggttgcaagatgaaataaaggac

SEQ ID NO: 4470 - DNA, 474 bp, Homo sapiens
  ENST00000525236
agatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaataaatacataaaagggagtgtaaagaagactgcttcactcaagaaggtctctgtttatcacttggtgtcctttctaagaaatgtcacaattatggaaaaaagaaacatcttatgaagatgtctaccctctacctaaagaccaatctgccacccttatgaaaataaac

SEQ ID NO: 4471 - DNA, 553 bp, Homo sapiens
  ENST00000527682
gtttactgcttacatacttacagcctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaaggttagaatctattttataattcaagttcaacattagacttttttgaggttacaggtgacacacacaaactatgcaagaaagagtcttgcagtaccgtgagacgtattttatg

SEQ ID NO: 4472 - DNA, 1620 bp, Homo sapiens
  ENST00000524560
agacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggccgacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaag

SEQ ID NO: 4473 - DNA, 5734 bp, Homo sapiens
  ENST00000619298
gctagtttaaggaaatttaaaatgtgtctgttttgtcttacagaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 4474 - DNA, 5925 bp, Homo sapiens
  ENST00000279463
tttctcttacagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 4475 - DNA, 4867 bp, Homo sapiens
  ENST00000611870
gcggagctcgagcgctgttgtgtgtttggaaggaaggatgctgctgccaatttgtgggaccgctgctgcgaggagtgggcgtggcctcggcggtgtggatgcttgttaggaaagatgctgagtgcttttcagtgaggagtcagggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacgggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttgaaaaatg

SEQ ID NO: 4476 - DNA, 3783 bp, Homo sapiens
  ENST00000622250
atgggatctgtcacgggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctga

SEQ ID NO: 4477 - DNA, 2338 bp, Homo sapiens
  ENST00000471618
tcattttctcttgcagccgccatgattctgaggccttcccagctatgtggaactatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggtgatttccatatgatttctttatgcaagaaaaagttcatttaaaaaaattaatcactcaaagtatgtatagctagccagatactgaacaagttagtgcaatgaagtaattaaataaaggtttgttttaatg

SEQ ID NO: 4478 - DNA, 558 bp, Homo sapiens
  ENST00000463177
ctgaggccttcccagctatgtggaactatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacacagcagtgatcctgtttgcagatctggagaagaaatgtatagaagtaaattactggtgggagaaagaaagaaaaagaa

SEQ ID NO: 4479 - DNA, 3708 bp, Homo sapiens
  ENST00000478060
atgtggaactatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctga

SEQ ID NO: 4480 - DNA, 4355 bp, Homo sapiens
  ENST00000476707
tatataattttatgatttttaaagtattttcatattctcctgtctttaagttttttcttttctcattgaacttactagacttctagtaagccctggaagtagtaggcatatttttagagatcttagatcctagtttttgatgttgttgttttacttgttggttgttttgtctattgattccacgaaagcctcagcactaactaaccctaacgtggcattgttcctcctggcagatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttt

SEQ ID NO: 4481 - DNA, 1856 bp, Homo sapiens
  ENST00000619533
caactaattcagttcacaactcaaaggttcacgtaagtgcttttcctggagacaatgatcagacttcagagtgcaccagaagtactttatttctgtttcccattttaacacacaaaatgttagaaagtcttgcagtcaagggtcaagatttaattaaatgaagagtttttacagcttcattaaggagattcttaaataaatttggctttttattccttttcctacaattgtctggcagtgtaatgttttctacttcatgaattcaatgattattattattgttttgtgtccttgcgttaatttgtgctaagtaccaggaattttacctaactttgttttataccaaatttggttccgtattaaaatggaaatggaaatgtcaacagagtgaaaaagacatcttagaattatcatgaaatagttttgagcccctgtgccctctcaaagtgtcccagggaccactacacgtctacagatcacactttgaggactactgacctaatataatgccagcgttggtaaccattgacatagttaagaatcgcagtacttagaatttgtatttacaactagaagtgttaaaacaacattcctcatatagaaataatttaggcatatttgtatatgtgttattggtcagaatgatttatttacataacccatttctgctgttcagcagtataacaattgaataacaatttcattaaaatgtttacatatttaatcacaaaacagtttaatcattttatgatgttgctactactccataatttcaaaataattaaaactaatatgaagtggccacatggccacatggtcctagagacatatagttaataccttgtgttaaatataaatgcaccaagtaaatccgatataatatgcattcataataaatgtaggtgaacccacaaggctgatagaactcagaaataaactcaacatacaataatactgcttgagccagaaatacctgaagtttttatatttccaatttatatgtagtagatgcttaaagtggaaaatagtgttatgatgacttattaagcaatgaagtcagcacagtttctatttggacagaaattctgactttatatttcttttctctctctaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttg

SEQ ID NO: 4482 - DNA, 4723 bp, Homo sapiens
  ENST00000377504
gcggagctcgagcgctgttgtgtgtttggaaggaaggatgctgctgccaatttgtgggaccgctgctgcgaggagtgggcgtggcctcggcggtgtggatgcttgttaggaaagatgctgagtgcttttcagtgaggagtcagggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacgggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggtgatttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttgaaaaatg

SEQ ID NO: 4483 - DNA, 4867 bp, Homo sapiens
  ENST00000307431
gcggagctcgagcgctgttgtgtgtttggaaggaaggatgctgctgccaatttgtgggaccgctgctgcgaggagtgggcgtggcctcggcggtgtggatgcttgttaggaaagatgctgagtgcttttcagtgaggagtcagggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacgggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggtgatttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttgaaaaatg

SEQ ID NO: 4484 - DNA, 560 bp, Homo sapiens
  ENST00000423939
gattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaacttgaggctcttaatagaatggcaagaagaacaagaagtaagaaagcctggagaacaagaagtaagaaagcctgaaagactcaaacactgtataatttttctctgaataagctaat

SEQ ID NO: 4485 - DNA, 5284 bp, Homo sapiens
  ENST00000431078
gattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactacaactgtgatgatccactagcatccctgctctctccaatggctttttccagttcctcagacctcactggcactcacagcccagctcaactcaactggagagttggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctggacctttgcaggaaacatgaatgctgacagcgtggtgcaccacaagctattgcactcagtgagagcccgatttgttcgctttgtgcccctggaatggaatcccagtgggaagattggcatgagagtcgaggtctacggatgttcctataaatcagatgttgctgactttgatggccgaagctcacttctgtacaggttcaatcagaagttgatgagtactctcaaagatgtgatctccctgaagttcaagagcatgcaaggagatggggtcctgttccatggagaaggtcagcgtggagaccacatcaccttggaactccagaaggggaggctcgccctacacctcaatttgggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgagcttagttttggaggaattccagtaccaggaaaacctgggacctttttaaagaaaaacttccatggatgcatcgaaaacctttactacaatggagtaaacataattgacctggctaagagacgaaagcatcagatctatactggcaatgtcactttttcctgctccgaaccacagattgtgcccatcacatttgtcaactccagcggcagctatttgctgctgcccggcaccccccaaattgatgggctctcagtgagtttccagtttcgaacatggaacaaggatggtctgcttctgtccacagagctgtctgagggctcgggaaccctgctgctgagcctggagggtggaatcctgagactcgtgattcagaaaatgacagaacgcgtagctgaaatcctcacaggcagcaacttgaatgatggcctgtggcactcggttagcatcaacgccaggaggaaccgcatcacgctcactctggatgatgaagcagcacccccggctccagacagcacttgggtgcagatttattctggaaatagctactattttggagggtgccccgacaatctcaccgattcccaatgtttaaatcccattaaggctttccaaggctgcatgaggctcatctttattgataaccagcccaaggacctcatttcagttcagcaaggttccctggggaattttagtgatttacacattgatctgtgtagcatcaaagacaggtgtttgccaaactactgtgaacatggaggaagctgctcccagtcctggactaccttctattgtaactgcagtgacacaagttacactggtgccacctgccacaactccatctacgagcaatcctgcgaggtgtacaggcaccaggggaatacagccggcttcttctacatcgactcagatggcagcggcccactgggacctctccaggtgtactgcaatatcactgaggacaagatctggacatcagtgcagcacaacaatacagagctgacccgagtgcggggcgctaaccctgagaagccctatgccatggccttggactacgggggcagcatggaacagctggaggccgtgatcgacggctctgagcactgtgagcaggaggtggcctaccactgcaggaggtcccgcctgctcaacacgccggatggaacaccatttacctggtggattgggcggtccaatgaaaggcacccttactggggaggttcccctcctggggtccagcagtgtgagtgtggcctagacgagagctgcctggacattcagcacttttgcaattgcgacgctgacaaggatgaatggacaaatgatactggctttctttccttcaaagaccacttgcctgtcactcagatagttatcactgataccgacagatcaaactcagaagccgcttggagaattggtcccttgcgttgctatggtgaccgacgcttctggaacgccgtctcattttatacagaagcctcttacctccactttcctaccttccatgcggaattcagtgccgatatttccttcttttttaaaaccacagcattatccggagttttcctagaaaatcttggcattaaagacttcattcgactcgaaataagctctccttcagagatcacctttgccatcgatgttgggaatggtcctgtggagcttgtagtccagtctccttctcttctgaatgacaaccaatggcactatgtccgggctgagaggaacctcaaggagacctccctgcaggtggacaaccttccaaggagcaccagggagacgtcggaggagggccattttcgactgcagctgaacagccagttgtttgtagggggaacgtcatccagacagaaaggcttcctaggatgcattcgctccttacacttgaatggacagaaaatggacctggaagagagggcaaaggtcacatctggagtcaggccaggctgccccggccactgcagcagctacggcagcatctgccacaacgggggcaagtgtgtggagaagcacaatggctacctgtgtgattgcaccaattcaccttatgaagggcccttttgcaaaaaagaggtttctgctgtttttgaggctggcacgtcggttacttacatgtttcaagaaccctatcctgtgaccaagaatataagcctctcatcctcagctatttacacagattcagctccatccaaggaaaacattgcacttagctttgtgacaacccaggcacccagtcttttgctctttatcaattcttcttctcaggacttcgtggttgttctgctctgcaagaatggaagcttacaggttcgctatcacctaaacaaggaagaaacccatgtattcaccattgatgcagataactttgctaacagaaggatgcaccacttgaagattaaccgagagggaagagagcttaccattcagatggaccagcaacttcgactcagttataacttctctccggaagtagagttcagggttataaggtcactcaccttgggcaaagtcacagagaatcttggtttggattctgaagttgctaaagcaaatgccatgggttttgctggatgcatgtcttccgtccagtacaaccacatagcaccactgaaggctgccctgcgccatgccactgtcgcgcctgtgactgtccatgggaccttgacggaatccagctgtggcttcatggtggactcagatgtgaatgcagtgaccacggtgcattcttcatcagatccttttgggaagacagatgagcgggaaccactcacaaatgctgttcgaagtgattcggcagtcatcggaggggtgatagcagtggtgatattcatcatcttctgtatcatcggcatcatgacccggttcctctaccagcacaagcagtcacatcgtacgagccagatgaaggagaaggaatatccagaaaatttggacagttccttcagaaatgaaattgacttgcaaaacacagtgagcgagtgtaaacgggaatatttcatctgagaaactgcagggttcctactactcttttttcttgttgttcaattatctcctccccctcttctctcctgtcttttgatttggtcattctctttattttctgcttgccatgtcttttctggaacatacttgcatccaccacagcatcaattcccttgatccagcccaagagaccaggcagccatggccactgccttcctctctgatgaacctatcgggtgaaaacgaccactcaagagactgacttcgccattcaagacaaggaagagacacatgtgtgcactcctgcatgttcagttctgtacttccagtttctaaaatgcactgttcagttttccaaccacttggtggttcaggcttgctttgaacctgagctcttaggcacatgacggtcattcctgacatcctccccagctcaagtctattcttaccatagaacccagggcagggagagaagaacctagaggcctggtttgctttggtggcattgtaaaaagagtaagagaggtttggtttgtggtggtttgctttctttaccataagcaatcccttgccttaactcatcaccctttttcactatgacccttagaccctgagtattttcaaatatatgattgctgatagtagtgaccaaaactactttgttcctttcttaccactctctcctggggccgacacgttgggacagcacaccatagcataaagctaggggatgcatggaaatagcagcttgaaactaggaggtaacaagaaagcttctaggaagtagatgttccatatcttcaaaatgcctcctccaattttgtaagaatgctagctaggtattcctgggattattatactgagatatatatatatacacacacacacacatatgtgtatatatgtatatatatatgtgagtatatatacacacacacacacacacacacatatatatatatacacacacgcacacatatatgttgctgcagcataaagaaattgaaataaaagtttaaa

SEQ ID NO: 4486 - DNA, 347 bp, Homo sapiens
  ENST00000470921
acaactgtgatgatccactagcatccctgctctctccaatggctttttccagttcctcagacctcactggcactcacagcccagctcaactcaactggagagttggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctgggtaggacatctttttccttccaatgaataaaactgagatgtgctaatg

SEQ ID NO: 4487 - DNA, 4780 bp, Homo sapiens
  ENST00000431948
ctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaactaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctta

SEQ ID NO: 4488 - DNA, 4660 bp, Homo sapiens
  ENST00000445054
ctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctta

SEQ ID NO: 4489 - DNA, 5291 bp, Homo sapiens
  ENST00000265136
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctta

SEQ ID NO: 4490 - DNA, 7697 bp, Homo sapiens
  ENST00000462395
taagaactttgtgactgcggaatcattgagaaacattttctacattccagaccgcttctagaactctgaaactttgtgactgcatttacaaaggagtgtttaaaacacatgtgagaccttggagagctgcaccgtccagtatgtgtgtggctgccgagcgcttgccaagtgtctggtccaaattgacatgtgctgttaagtgtaaaatatacatcaaatctggtacagaaagaaataattttatattaattattggcagaaatcactaaattgttttattaaaattctacctatttctttatacattttcaatgttattataaaaatattttaaattatacatgtggctcatgttatattgggcaccattgttctaggactctgaagctttgctaatacaggaacatttacaaatggaagggggaggttaagcacatacgactatcatcaactgcatattttcccaggcttcttgcctttagttaatcaagtaatcactttgaaatcacaggagttggtttggttgtcattagcaaattggattgctacctaaaagcaacatctctctcctctcagactttttttttttttcattaattctgccactgtactagcctcatcaaaaagaaaaagtgacctcatgtgctatgaacccatcttgtacatttcggattggtcagattcagcccattctccctcatagcaaatgaaaacaacaaatcaaaaagcgcttttggctcctggcactaactgaatttgactgtccctagttctcgtttttgctggaggctggggtatgaatgcagaggctcagcaagccctgcacacacccggctgggtggatcggtcagcctgccaccctccgaccatcccaagaggctgggcccaaggacgcaggtccacttcctgggcagactctggtttgaaacttgccggtgctgagctgtgtccctcatattgcatgccccagtagcctaaacattcacattccctgcagagtccccaactccgtgtgagaaaataactgcaatacttattcaacacatgcagcctgatatcaaaatgtcttccctgtgtttgtttgcatttatttccttgatcttaagccagaacaaactgtcaataaggaacgtttctaaagattgaggtatgtgttggtgggggggaaggaagcccgggagaaaaacatctgggcaggtttactttaagctaacagaggctgatgtttcttgctgactgctaactcttcagggacacatacctagggctcccctgctaagcccacagggaactggcctccaagcccagtgactaagggcataaatctggtggttttgcaaagagagaggaatgtttataatccattagtaaccctttggagagaagtagatgggagttagtaaggaaggaaaatactgctgtctctccctcctgctttcttacactggaaagtaaaatcactacattgccattggctctggcttttgctagataatccattcatacatgctcagaacacagccgccctgttttgcatcaaaagaagagcaggctgctcctctttcctctctcagagatgccaggagcttggcagcctcaggaggaacaccaaacaaggtcctgggctgcgtggtggccagaccttccctcactccacggtgcacacaggctgggagctcctagctcatgtccactctttctttcagggcaagcagggccccaaggagccagccccacactgaagtgtgggggagcaaagctggagcagaggtgggatgcagaggtaccagcattgcctggaaccaagcagcagcgtccggggcaacctctatagagtgccaagtgaggccagtggtgggagggagctggacaggaaaaaacacagggatgaaggactagggctgagcacagggtccccagactccagaaaggcagctgtaactggtggataggggagaaaccagctcagaagcagccccaagcgcctggagctgggctcctgctgtttctagagggcagggagcccggagcctgggaggaggaaggtgttgaagggctgagactgttcagaccttgtacagcctctctgttacagtttcaggctgacagccacgcactaagattgctaggcactcagtaacaaaataaagtgcttactgtgtgcagtgtaagaagaatgcagactcctttgcaggaaagaattcttgttcactaaaggacaaaattatccttttaaattttgctggctaaaaatttgctctgtcactcaagctgctttgaactcaaccaagcacagttctaaagaaaaagggtaaaatattcatcctaattcatccttttccttaagtcatgctggttggtttcttgttagatttctgtctccgccttgtccaaaggtatttgctatttttaaatcatcacagtgtttctatatatgtgtgtgctgatttcttcacataacatgctaacataagcatggatgtgtgtttctacatagacttaatgatcatcatatttactgattttaatgccctttgaaatatatatgtaataatttaggtaactgcctagtgctggacatttctagaattcttacatgaactttgttgtatttatatttttccttctatagggtttccttaaagcagattattaaaaaagagattaatgggccaaagttcttacaaagataacgtgatttttgtttgtgtgttttttgatatgtatttccacattgctttccaattaaaacctgtagcaacaagtgtgggtctgtcagattcatcacatcttcatcagcttggggtgggtttttgttttgttttgttttgttttgctattttgcaaaatggtagaatcagtggagtttttatcttattattttttttaattcttattgatatcattatgttccatgtctcatagtgacgtgatcaagcatactttaaaataaaggcaaatactttgaagtaaaagtatgtctgtaattttgtttggctgggctttaagcatcctaaactaagagcaagcatttaaaaagttttccatctttccaagtatttaaatctcttttccatttcagattgctcttttatatggcaatttccatttttctctgccatatattttattaaaaatttaaatgtatttaaaccatctcattccatgaaagagaaaagcagaactttagtaaagtgcattcaaataattaaagtccatggcaaaagcaatagggaagacagtcatgcacctcttgtggtccttattaatgggtccacatgcacacacatctccaaccagccccctttgtgtagcttgtcagaggacattagctgagactaatctggaagccacttcctggctcccaaatggacatagtcaccaaatcagaaagactcatttatcagaataaaaactttgctacgtgaggattgtgcaaagcttatttcatgcatcattatctgggcctgattagcagtgatggaaattggtcctcaatttttaacaatcagcggaaaacaaaccttcagctttcactgaagatagacaattgccatagacatgtctctgtgttttctgcacaataggaaaatagaggcaagagcccttgcaaagacagtttttaaattgttttggcagcagttgtctcacagatgccattgtccctgtgacgcaaatgaagccagatcccgctctctgagcagacgggttgacatcttcctggatgccccgtgccacaggggccacattattatgtgttgtggccccagatgcagctggtccttcttgggctttgggggcaggcaggcctggttccagatgccagtgtgacctgggcagctctgtagtctctccgtacatagtttcatcactgtacaacagtgacaacaacactacctgcctgaaaaactgtgagggttataataagataatttatgcaaaagagctctgtgcgggggctggcacaaaggcatgcagacaggcctcacactgctaggagcttcctcctgttaagtctgagaggaggcccttgggaagggtcttgcggagtcaagggtggagcagttactcctgctactgttgctgtgaggttttttggccatccttattgtccttatgtcccagttcaagattctagggagtacagctcttcaagtggcattatcaggcccccaagccctgcccctgcaagtggcattatcaggctccctgtcacccaccaagggtaggaattaagccaaagtaaacatagagtctgtaaaagtcatttatagtagaggagtgaaatttctcgttttctgagtctggcagggtgggctactgctagggtggacacagatggaggctgagcttatgaagttggtgggacttctgggaacactcccccatgcagccctgcacaaccctccccacggacctcctaacagcaggcagatcctgcaccagaggtatgtagcctttatcactgggaccttgaacgacgctgcactcaaatccgcaagtgccaaggaacagccgggctgtgcagtgttgaggtgaggtggaccagcctccagccacgtgcacatgcttggcctccagatggcttcactccttcttgccaggtgccaggtgcaggggactgctgtagcgcaaggcacagatgcaagcaaatcctggatcacgtgaaccgtcttttgtgcggtggaattaaaactttgacttcagtctgcagagtgaatgaaagctgtgtgtggtttggttactgtaacactttggggccccacacacacaccatatatcacatgtccaccacatacaagacatatactccacacatgcacacacgctacacgcatcccacacatacctgtgcacacacatgggggacacacacacccatgaacaatctgcgtctccgtagttctgaggacaacagcagtacagtgagtatgtgactgcttgaatttgagtatgagctgttctatcctcagatattcctggaaaggagtacattaaatcaatagtaagagaaatgagtgctcctttctctttggtcttccctagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaa

SEQ ID NO: 4491 - DNA, 1842 bp, Homo sapiens
  ENST00000452534
ccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaactaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttca

SEQ ID NO: 4492 - DNA, 2332 bp, Homo sapiens
  ENST00000395540
ccgcccgctagagacgattccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtttatggagcagctgaagctgtgataagacttctgagcttgcttctgaataccacagccccgggcacagcaaagccaagaaccctgtggatgagtgagggccgcagttctctacacaatcctgaaatcaagtgttcctgtttctcttcctcctccccatttccccagtcactgctcagccttctcttgggtctttcaagcatttgtgaatgcatgtgcacacttagacacacacacgcacacacacacaacccatcttgtgtcttacctacctctgaaatattggcatttgggagacaatccctaatcagctaacacttgtttttttctatcctctgtgtgcttgttagaatactgtgaaggtgttttctatggaccgacttctaaatgttcctcctgaaatcagtgttattcacacagttctaatgtaatgaattctgtctgtctgaaagcttgccatattgtccctggtttctcccagctaatagagaggaaaatgagcctgaatatgaacccgtcaccacagaccgcactgcatcctttccaggcagcagggccctggagactgtgctcaggcctggcagcctctgtgtttcacttaggcttgttttgctcaacccaggcaagacttttaaaattgtttgaataagctgcagcatcagtatgcttttttaaattgtgatttaaaaaaaaatataaaatgtcccattccttccattttcaaatgcatacttcagtagatttaagtatattcacaatgctgtgaaaccgatctccaggacctcatcgtcctgcaaatctgatactctactcactgaacagcaactcccctttgcctgcttgtctttttgcgcctggcttatttcacttagcacaatttcctcgaagtttatccatattgtagcatataacagaattcccttcccttttaaagctaaatatctttcaagtatatgtatagaccacattttctttatccatccattgtcagtggacatttaagttgttcccgcttcatggttattgtgaatgatgctgcacaggtatgcaaa

SEQ ID NO: 4493 - DNA, 3785 bp, Homo sapiens
  ENST00000441453
ctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtttattgctgtgcgtcattccctactcaggccaagcgcttctgatggacgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggtttatatttttttgaaggaggtaaattatatgcaaattttaggttgataatattcacctgtctgaaattcactgatacttggaaatgttcctgtgaagaactctgctttattttaattcattattaattcatgtttttcttattggatattcagttccagaatttattgccaatttttcttaaaactagattgtatccataaattgaccagtatagtcaatttggatagaactgaaactttctgtctacctggtaaaactaagtgcctaaaaacatgaactataaatgtagttactaggaactcacaacttatatatactatccattcaatgatacataggacccaatgtctttgtgtttttgaggttttcctgttactgtgtactttgccattttacatagttcactaaaaagaaagaagtgggagaagaagggtgttctattcattattctatattatgattctcttcattattctgttctcttcattattctattcatttcttcacccatttattcactaaacagtgacatagtacttacttgatgctaggtattacaccagttttgtgggctataagagtgaataacaagcacgtgacctctggccttggattttactacctgtggctccccaggcacatgaaaagaagtaaagatggttccatttgataagtactagtcacaagggttgtacatgtgataaagatgccagaggttgtgaccaccatgtctgtgcagaggtgctgctggctcctctttgagtgtgagatccctctgcagtcacacaacctcacccagttacgaagagctagtcacctcaactgcattgtcccaagacaggcagagtaggtaaaaatagtcatatgttaaaattcaaggtttagataaaaagacaactagttcttgcttgctttgattaacttttattatgcagatgcatttgaactggagaagcttgtcatgtttctctctaaaagatgtttttaaatgttattgctcaaaatggaaaaaaaaaaaaagaatcagtaagtattcctgacatgtaggattgttgcctggctgatcacaatgaaaatgttagctatgactaatgaaggaattatcacaacttacattggtattaataataaacaaatataagccaaagctatatataaccaatttagtgctatgtattggtgaaaaaaacagaaagttacagaaattactcacaatgaaacatagaacaagttagaaagggccttttttttttttgaaataaaggacttttgtctgataagtagcagtcatttgacctcaaatcattaaatggggaaagtctaaacaagaaaaggtaatgtttacctgaatgttggggaaagcattaggatttatggcccagacttaaagattgtagaagattgtatataattacagcaataagcatttgtgtaagaagtagctattatgctgaagaaagatgggcacacaaaatctctaggcaaatccttggaacaggggaaagtgatactgctcatagaattattggttcgagaggcagcaaatatgatgcaataagtatatcaaactcaattaaaaatagaggacagaggtatgtggtgggggaaaacaaatgcaatagggctaagtcagcttacagggggtgaatataatttgaacatggcacccccaatttacttgatcataaagttagccaaagacatgagtggtcgatctttgacaatactctagtgatctccatgagagatggcctgatagatgttggatagaatgaagggccatttgatgaacaagttttgtagatttacatgtgacttggcactgtgctgacattagagccttctaagaatcagataaattaattaggtgaaacattttttcccaaagcacttgcatttcagaaagtttctcatttctgactcagcttagaacccatcccttgttacaggtcatttctcctccttataagccatgtctgtttcttttttccatcatgtcatacaccctatccacaaaagatggtagctcacgttttctaactagagacgtgcaggcaagttgagagcatgaagaatcccttgggaataccaattctgtagcaaatgctaaggtaaaagaaaaactatgcattatttttcaactatagttggcttaaattcttagtttcaccctggagaccatgttgccagtggacaattgagcatgctgtgatttataaaatgcaagctagtttatatgataatgtttgccatctcactttaccagtactgttgaccttttcatatgattctaaaatcacttacttgtaaataaatactcctagttctgtagatgaaa

SEQ ID NO: 4494 - DNA, 1941 bp, Homo sapiens
  ENST00000632460
tccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagttcgtctgagcaaaactcagtccgagccttccctgagctgtcaagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtttattgctgtgcgtcattccctactcaggccaagcgcttctgatggacgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggtttatatttttttgaaggaggtaaattatatgcaaattttaggttgataatattcacctgtctgaaattcactgatacttggaaatgttcctgtgaagaactctgctttattttaattcattattaattcatgtttttcttattggatattcagttccagaatttattgccaatttttcttaaaactagattgtatccataaattgaccagtatagtcaatttggatagaactgaaactttctgtctacctggtaaaactaagtgcctaaaaacatgaactataaatgtagttactaggaactcacaacttatatatactatccattcaatgatacataggacccaatgtctttgtgtttttgaggttttcctgttactgtgtactttgccattttacatagttcactaaaaagaaagaagtgggagaagaagggtgttctattcattattc

SEQ ID NO: 4495 - DNA, 589 bp, Homo sapiens
  ENST00000449281
agtggtggagcaggtggtgcggtgctggtgttgggtgctggtgttgggtggtggtgcgtgctgtgtactttgggcacccgggtcgttgcccaggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaat

SEQ ID NO: 4496 - DNA, 5339 bp, Homo sapiens
  ENST00000395542
ccgcccgctagagacgattccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaactaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctt

SEQ ID NO: 4497 - DNA, 7286 bp, Homo sapiens
  ENST00000370096
gtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgga

SEQ ID NO: 4498 - DNA, 5289 bp, Homo sapiens
  ENST00000635193
atcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaaggatttcagatgtcattggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatg

SEQ ID NO: 4499 - DNA, 1113 bp, Homo sapiens
  ENST00000639098
aggaaggttatttaccagttaaactccaaccatttgcatcttagtgcacatgcttgagcccagtagcccacctcctgagatcgtataaagaagctgctggtcaccagtttcaggtgttttctatgaggaacaggaagactgccattccctggcaccagctgcaaccaattgttttagcaagacagtttaacaactgcctgaccttcatctgatggtcgcctgacattcctggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaa

SEQ ID NO: 4500 - DNA, 785 bp, Homo sapiens
  ENST00000470170
catgcttctggcatcacagttcactgtctgcagtgatttaattctttgtagcataaaagaggaaaagagtcattaggtgtctttttattcctttattcctagctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaa

SEQ ID NO: 4501 - DNA, 5442 bp, Homo sapiens
  ENST00000512756
tgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggagataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgcca

SEQ ID NO: 4502 - DNA, 297 bp, Homo sapiens
  ENST00000465209
ttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttgtaagtatgatgataataaatagccagacaatcatggttgtgaattacagctcttctttcattactctcatgctgtgattccacagtgtgtgggagagaaaataaacacatgtcaatcaaa

SEQ ID NO: 4503 - DNA, 678 bp, Homo sapiens
  ENST00000461720
caaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaatgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcata

SEQ ID NO: 4504 - DNA, 377 bp, Homo sapiens
  ENST00000475980
atggagaaattggaccaagaggtcttccaggtgaagctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaagtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacac

SEQ ID NO: 4505 - DNA, 1709 bp, Homo sapiens
  ENST00000427239
atggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagaaaaagaaatccaatttcaaaaagaagatgaggacagtggctactaaatcaaaggaaaaatccaaaaagtttacaccccccaaatctgaaaaattttcatccaagaagaagaaaagttatcaagcatcagcaaaagccaaactaggggtaaaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatcc

SEQ ID NO: 4506 - DNA, 776 bp, Homo sapiens
  ENST00000447608
tacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgaggtgaggagcacaagaccagagaaggtcttcgtatttcagtgatatggacatcgcagtgcagtttttgaacttatacttatttattccattttaattaagctatgctttgtattttaattgtgttgtaatatttccaggaaaaagtgacttgaatatatttggtacttgttttcttgctgtttaagcatttgattacataaatttattagcaataa

SEQ ID NO: 4507 - DNA, 7173 bp, Homo sapiens
  ENST00000353414
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgg

SEQ ID NO: 4508 - DNA, 7327 bp, Homo sapiens
  ENST00000358392
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagaaaaagaaatccaatttcaaaaagaagatgaggacagtggctactaaatcaaaggaaaaatccaaaaagtttacaccccccaaatctgaaaaattttcatccaagaagaagaaaagttatcaagcatcagcaaaagccaaactaggggtaaaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgga

SEQ ID NO: 4509 - DNA, 6209 bp, Homo sapiens
  ENST00000425729
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 4510 - DNA, 1984 bp, Homo sapiens
  ENST00000496849
aaaaccaaagcccacaagcccacagatccacagtcccacacactgcaggcctgggccagctgtgtttgcttgggtttgggatggattggagggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctccc

SEQ ID NO: 4511 - DNA, 2099 bp, Homo sapiens
  ENST00000452044
acacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccct

SEQ ID NO: 4512 - DNA, 1194 bp, Homo sapiens
  ENST00000435763
agccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggtgagggagctgggagaacccccaagtgcagcacaccccagagagggaagacacccaggcatctctcctccttagttgtcctccccaccctcatctccctattcccatcaccccctcctcctagtcctcattcatcagcctttttattttcatctaaaaataaaaagagttgttatgaagaa

SEQ ID NO: 4513 - DNA, 6104 bp, Homo sapiens
  ENST00000552134
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4514 - DNA, 6425 bp, Homo sapiens
  ENST00000551413
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4515 - DNA, 6209 bp, Homo sapiens
  ENST00000447349
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 4516 - DNA, 1984 bp, Homo sapiens; identical to SEQ ID NO: 4510
  ENST00000496392

SEQ ID NO: 4517 - DNA, 2099 bp, Homo sapiens
  ENST00000452730
acacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccct

SEQ ID NO: 4518 - DNA, 1194 bp, Homo sapiens
  ENST00000447741
agccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggtgagggagctgggagaacccccaagtgcagcacaccccagagagggaagacacccaggcatctctcctccttagttgtcctccccaccctcatctccctattcccatcaccccctcctcctagtcctcattcatcagcctttttattttcatctaaaaataaaaagagttgttatgaagaa

SEQ ID NO: 4519 - DNA, 6104 bp, Homo sapiens
  ENST00000552473
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4520 - DNA, 6425 bp, Homo sapiens
  ENST00000549885
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4521 - DNA, 6209 bp, Homo sapiens
  ENST00000383219
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 4522 - DNA, 2099 bp, Homo sapiens; identical to SEQ ID NO: 4517
  ENST00000420405

SEQ ID NO: 4523 - DNA, 1194 bp, Homo sapiens; identical to SEQ ID NO: 4518
  ENST00000383088

SEQ ID NO: 4524 - DNA, 1984 bp, Homo sapiens; identical to SEQ ID NO: 4510
  ENST00000433947

SEQ ID NO: 4525 - DNA, 6425 bp, Homo sapiens
  ENST00000549836
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4526 - DNA, 6104 bp, Homo sapiens
  ENST00000549491
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4527 - DNA, 5868 bp, Homo sapiens
  ENST00000443138
gtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 4528 - DNA, 1790 bp, Homo sapiens
  ENST00000447855
gtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccct

SEQ ID NO: 4529 - DNA, 898 bp, Homo sapiens
  ENST00000434780
gtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggtgagggagctgggagaacccccaagtgcagcacaccccagagagggaagacacccaggcatctctcctccttagttgtcctccccaccctcatctccctattcccatcaccccctcctcctagtcctcattcatcagcctttttattttcatctaaaaataaaaagagttgttatgaagaa

SEQ ID NO: 4530 - DNA, 1984 bp, Homo sapiens; identical to SEQ ID NO: 4510
  ENST00000486982

SEQ ID NO: 4531 - DNA, 6209 bp, Homo sapiens
  ENST00000383087
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggtcctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccctgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 4532 - DNA, 1984 bp, Homo sapiens; identical to SEQ ID NO: 4510
  ENST00000443125

SEQ ID NO: 4533 - DNA, 2099 bp, Homo sapiens
  ENST00000451040
acacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacgagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccct

SEQ ID NO: 4534 - DNA, 1194 bp, Homo sapiens; identical to SEQ ID NO: 4518
  ENST00000439039

SEQ ID NO: 4535 - DNA, 6425 bp, Homo sapiens
  ENST00000549811
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacgagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggtcctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccctgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4536 - DNA, 6104 bp, Homo sapiens
  ENST00000551542
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggtcctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccctgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4537 - DNA, 6209 bp, Homo sapiens
  ENST00000374708
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggatgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccgactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 4538 - DNA, 1984 bp, Homo sapiens; identical to SEQ ID NO: 4510
  ENST00000477772

SEQ ID NO: 4539 - DNA, 2099 bp, Homo sapiens; identical to SEQ ID NO: 4533
  ENST00000457788

SEQ ID NO: 4540 - DNA, 1194 bp, Homo sapiens; identical to SEQ ID NO: 4518
  ENST00000395194

SEQ ID NO: 4541 - DNA, 6425 bp, Homo sapiens
  ENST00000341947
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacgagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggatgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccgactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4542 - DNA, 6104 bp, Homo sapiens
  ENST00000361917
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggatgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccgactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 4543 - DNA, 6209 bp, Homo sapiens; identical to SEQ ID NO: 4537
  ENST00000448717

SEQ ID NO: 4544 - DNA, 1984 bp, Homo sapiens; identical to SEQ ID NO: 4510
  ENST00000494246

SEQ ID NO: 4545 - DNA, 2099 bp, Homo sapiens; identical to SEQ ID NO: 4533
  ENST00000438711

SEQ ID NO: 4546 - DNA, 1194 bp, Homo sapiens; identical to SEQ ID NO: 4518
  ENST00000452937

SEQ ID NO: 4547 - DNA, 6425 bp, Homo sapiens; identical to SEQ ID NO: 4541
  ENST00000551758

SEQ ID NO: 4548 - DNA, 6104 bp, Homo sapiens; identical to SEQ ID NO: 4542
  ENST00000550998

SEQ ID NO: 4549 - DNA, 3135 bp, Homo sapiens
  ENST00000425443
gtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccagagccttacgtgcccgagggcggggcctacctgcctgagcgcgagcccttcatcgtgccggtggagcccgagcggacagcggaatacgaggactacggcgcagacgagcctgcagaggagcctcctgagccccaccggcgctggcggcgcgccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 4550 - DNA, 11723 bp, Homo sapiens
  ENST00000322507
acttggctaaggcgaaccgccccagacgcgtccgcgcgccggcagctgcaggctcaggccatctccagtcttcctgccgcgcccgcctctcctcctgggattctcctcctcctcctggacttccccgcagctgcccacgcctcggcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctgctcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgataccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgccttccaaatcatgccataattgtaatgttgaatcggacagagccttacgtgcccgagggcggggcctacctgcctgagcgcgagcccttcatcgtgccggtggagcccgagcggacagcggaatacgaggactacggcgcagacgagcctgcagaggagcctcctgagccccaccggcgctggcggcgcgccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 4551 - DNA, 5886 bp, Homo sapiens
  ENST00000345356
caccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctgctcctgtcttccattgaggcagaagggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggttccggctaacacattttctaagtcgccagtgctgcttacagtttgaatacatgaaaatcctgtttctgagatgtttgcgcacgtg

SEQ ID NO: 4552 - DNA, 8964 bp, Homo sapiens
  ENST00000416123
atgcggagtaggcttcccccagcgcttgccgccctgggcgcggccctgctcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgataccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaagagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggttccggctaa

SEQ ID NO: 4553 - DNA, 9637 bp, Homo sapiens
  ENST00000483888
aagccgctgtcgccgccgctacctctccctgttgccgccgcctcagatctcttcatgccgctgtaagctcggaggccaaggatgcggagtaggcttcccccagcgcttgccgccctgggcgcggccctgctcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgataccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccaggcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggtacgttgttgccattgtaggaaccccaactcacctgaagtaaagaactttacggaaatgaagttccttaggattgaaggaaggctgatttgaagatgtcttgaagataacaactctttcagttctgattatataataatagtgtttgctatcatagcacacaacattatttcactgttaggattgaattattttcttttttccccatgtttctgcatttaccaaatcacatcataaacctccccttacttctcttgggacttcaaagcatgctagtaattgactttttttttttcttttccccaagattgggaacagggatttgttaaatacaactgtaaaatgccaagaatatgtatttaaaaattgttttgggaatctaattta

SEQ ID NO: 4554 - DNA, 571 bp, Homo sapiens
  ENST00000511023
aaagcagaagcctggatatgtgtttcacctcatttccatttcataccctggtcttaaccttcaagttggtgctattcaattcagggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagaga

SEQ ID NO: 4555 - DNA, 794 bp, Homo sapiens
  ENST00000493109
gtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggtaaaaacataagattatttgagtcttatttctagaaaaaaatataaaacaaatttattatttattaaaatgtcatgttaaattggcagaattataactatgtcttttaaaaataaaatcttgttttagagaatttggttaattcaaataatatttaaaataaaacaatatactaatcaaga

SEQ ID NO: 4556 - DNA, 1914 bp, Homo sapiens
  ENST00000419671
gaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacacctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgca

SEQ ID NO: 4557 - DNA, 499 bp, Homo sapiens
  ENST00000474564
gaaaggaactagactgatggtctgcttttctgttttggaagtgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtaggttgaagatgatagtagatatgaaaatatttgttttcctagtag

SEQ ID NO: 4558 - DNA, 1554 bp, Homo sapiens
  ENST00000486533
gtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaaggtagaggaaat

SEQ ID NO: 4559 - DNA, 11579 bp, Homo sapiens
  ENST00000615798
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctgctcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgataccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcattcacggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgccttccaaatcatgccataattgtaatgttgaatcggacagagccttacgtgcccgagggcggggcctacctgcctgagcgcgagcccttcatcgtgccggtggagcccgagcggacagcggaatacgaggactacggcgcagacgagcctgcagaggagcctcctgagccccaccggcgctggcggcgcgccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 4560 - DNA, 2934 bp, Homo sapiens
  ENST00000479733
tgtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtgggagtaaagggccaaccaggcgagaaggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggtctagatggcccaactggggagaggagaacatggtggccagagcagacccagagtggcaggattgcctaatccagctgggctcctgaggtttacaggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtc

SEQ ID NO: 4561 - DNA, 3093 bp, Homo sapiens
  ENST00000398978
gtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatggcaattca

SEQ ID NO: 4562 - DNA, 3027 bp, Homo sapiens
  ENST00000354547
gtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatggcaattca

SEQ ID NO: 4563 - DNA, 2991 bp, Homo sapiens
  ENST00000357811
gtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatggcaattca

SEQ ID NO: 4564 - DNA, 2276 bp, Homo sapiens
  ENST00000520267
ggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccggctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtg

SEQ ID NO: 4565 - DNA, 2007 bp, Homo sapiens
  ENST00000517713
atggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtga

SEQ ID NO: 4566 - DNA, 2061 bp, Homo sapiens
  ENST00000522165
atggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccggctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtga

SEQ ID NO: 4567 - DNA, 1833 bp, Homo sapiens
  ENST00000520133
atggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggcgaagatggcttaccagtccaaggctgctggaacaagtga

SEQ ID NO: 4568 - DNA, 360 bp, Homo sapiens
  ENST00000484990
cttggccgcctaaccagcctcctctgcatcactgacctgtgctccgttcttccagaggtgtgtgtcctgccttctggcctcctgtgattctccacgccccctccctccaccttgcccggccaggtccaaggactccaggcttgtctagcttggcaaagctttgttcttggtgttcagctggacctgcaaacctcctagacaccagcatcacaacacagtcctggggcaattcccccgatccccaccccaacctcagagtgtcctggccagctggggccatggcttctggggaggatttcctgacttagggagtaaagggccaaccaggcgagaagatgagaagacaggcacggggacatt

SEQ ID NO: 4569 - DNA, 1057 bp, Homo sapiens
  ENST00000398975
agatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactg

SEQ ID NO: 4570 - DNA, 749 bp, Homo sapiens
  ENST00000456019
aggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaa

SEQ ID NO: 4571 - DNA, 290 bp, Homo sapiens
  ENST00000518052
ggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggacaccgaggttttaaaggagagaaaggggagccggggttaccagggctggacggactggatgccccatgcccattgggcgaagatggcttaccagtccaaggctgctggaacaagggccagagtccttggttagtcgccaagaa

SEQ ID NO: 4572 - DNA, 2586 bp, Homo sapiens
  ENST00000478219
tttattcccgcctgcccagtccctctctaggcatggacagtctaggcctccacgctgatcctcttactgcaaaagaagctgaagggaacacttcactccaaggctcaaggggttacagctctccccaaatttccccaataggtttggagttcaagagctattttatcataccagtaataagagaatttggggtctcacatccccgccctggggtcacacaggaattctctttgaacaaaagagaaaaagatacaagaaattatgctgtgtgaccctgaaaggtggtcgtagagccccttgaagggcagtagggactttttaggaggagcataggcaacaaaaggagagtgcagagcaagcaggcgggtagcatgcttcctgtccctgctggtcctgccaaaccctgcgcttgcagactgcacagccacctttctcaaccaggacttccaccatccacgcaccaatgggaatgccgctctggcccgcaggggctcccttgagcactggccaggtcttccctcagccacaatcccctcccacaatctgggcacctttagttctgccagcagctgccttggcctctctgttcctcaccatacattacttttcattctctgcctgccctgccctccatatccccctgccaccatccacacaccaatgggaatgccgctctggcccacagaggctcctctccctcccggcatccatgtgacgtgtgtcataccgcaccgtggcaggctggggaaggggcacagggtcaccctgaaactgtggaatgcacctcctccccctgcaatcccctccccaacccagaggggaaaatgaaggtcaccctgatttgactctccatgtaaaatggcattttcttccataacatcccatatcaatgtgtcaattttctattaattttactggggaagtgtcttccccttgtttctcactctgcctcctcctctgtgttattatgggcttgaggggcaggggtagctattgctcatgacttttactacaagataaccagacttcctaagccctccatattgggaccaatttctgctgaatgccaggtgatgagaggtttcagcccctggcgtgggtggatgacgtcagaccagggcagcagaggactctcattccacaagctccctcaggactgagcacttgctccgggtctcctgaagccccatgtccatctccttgtctgccctgccagtctagcagacttgggctgagaaccagacctttgcccttggcccagcctcgccttccccactgggtctctagatttctagattccccatagggtatgccagcaaggagaggatatgagggcccaagaaaactcaggaaagtttctatcaccaagggcagaacacgaacatcttgaggctaaaggagctgcatggttgctaccaacaaaggagaccgacggtgtgcagttgattcccatgtttttactgcacttcacccccaaattcccagcaaggtctaaggcttcgccaggaacccttgtcttcttgccaaaggcatgtcagggccatcctgcaatactcatgaggttgcctgtcccttcatgcccctcaccccaccccaggattaatcatcaaagaaggactgtctacatgtcctcctccctgtgcttaggaagagagacaaataagagaatgagaaggctgggaaggcccttagcggtcacatcaagcaactgtccttgccaaggttttatggaggaggaaactgaggccgccttgtgctgagtggcttacccgtgagcagccggcactccatagggccacagcagagactgtttcttcgtggcacggaaggacatctctgcttgctggtcccacgggctaggacagcccctattgacgttgcactatagctgcatgtgacctttaaccaatggtaaaatagccggatttgtttccacctccttctgaggttctgacctgtagtagagaaaagaaatagacaagcgtgggtgggccacatcctgatcagctgccaaaatgcgtgtggcccttgttacccctgtcctgcccacttggtggaccattgcaggaagtctgagccctctgccttcctttctccttgcagggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatggc

SEQ ID NO: 4573 - DNA, 2267 bp, Homo sapiens
  ENST00000398969
ggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccggctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtg

SEQ ID NO: 4574 - DNA, 276 bp, Homo sapiens
  ENST00000467052
cacccaagactgtgctccttcattcatccagcgtttattggcatctcctactacctgagctgttttaggcagggaacaaagcacagataagccctcctggagcttacattctgatgaagggggcaggcaaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtct

SEQ ID NO: 4575 - DNA, 1412 bp, Homo sapiens
  ENST00000471477
acaggacagacttaagggcgggagggagcccatcccgcttgccccaacgaacgcgggcgcggggctttcctcgcaggttacataaggcagccgcgggtggaggcagcagaggcgagcgcacgtccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactgtgagttaaagtcccactccaggtagatcagggaggtggatgaacagactcgccatgcaataaatggagcaactattattgttattattttattcttatgtcctcaaagaagcatgcgtgttatgatgggaaataacactaggcctggaaccccaaaacctagatttccatcctcagttttcaacttaccttgtaaatttgagacagttatccagattctctgatcctctctgtgtttccttatctgtaagtggagataagaaaacctaccccacagtcttgtaggtcaaataagataatctgtgtgaaagcactttgtacgttttaagattttatataaa

SEQ ID NO: 4576 - DNA, 5496 bp, Homo sapiens
  ENST00000375001
acaggacagacttaagggcgggagggagcccatcccgcttgccccaacgaacgcgggcgcggggctttcctcgcaggttacataaggcagccgcgggtggaggcagcagaggcgagcgcacgtccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccgggtgctttcttcatttga

SEQ ID NO: 4577 - DNA, 771 bp, Homo sapiens
  ENST00000496686
gatcaatatcacccatggattcatgaatttctcggacattcctgagctggtggggcctccggggccggacgggttgcctgggctgccaggatttccaatatggggttttgccatgttgcccaggctggtctggaactcctgagctcaagaaatccatctgcgtcagcctcccaaagtgctgggattacaagcatgagcccctgagcctggctgattttctgaactttttacattttctaaaggcacatatcatatgataacactaaaaatagtgctaactagacgttaaaaaacaaaagagagaatggcaaccatgaccacgattgtgaccatgactctgaccatgattcttggttagcagaagaaaaggccaaacccctaagctccagccccggcttggctgctccaagacctggggcacatttcagagcacactttcctctaaatgagtggtcctgtgttcctgagggagtcccaggctctgcaggagagcctccaggacctccactgcagggagtaaggagggggccaaataggcacattccaggccactgaccttcaataagggaagcttcactggacatatttgtatatattaggctttcatttaagactttatttgggggaaaaaaaaggaaggaaaagagtttcactgctaaacaataataacaaatagttgaaagccactgctgtaatgggtaattcactctttcatccagacaagacaggaacttgtgaaaagttaaaatagcaataaagtgttgaaatgcc

SEQ ID NO: 4578 - DNA, 5422 bp, Homo sapiens
  ENST00000610452
aggttacataaggcagccgcgggtggaggcagcagaggcgagcgcacgtccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaaggcaaaggggccatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccgggtgctttcttcatttga

SEQ ID NO: 4579 - DNA, 5436 bp, Homo sapiens
  ENST00000400337
ctcccagcggcggcggctgcagcgcggcggtccgagcgggtgcaccgcggcggaggaggcagcatcccgcggcgctgacggtcctggggagagcatggcgccgaggtgcccctggccatggccgcggcggcggcgcctcctggacgtgctcgcgcccctggtcctgctgctcggggtccgcgcggcctccgcggagccagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 4580 - DNA, 5924 bp, Homo sapiens
  ENST00000355480
agaggccctcccgccgcccgcagctccagccgcactgccccgatggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 4581 - DNA, 3386 bp, Homo sapiens
  ENST00000342220
ggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcagggcaggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 4582 - DNA, 588 bp, Homo sapiens
  ENST00000459895
taagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccaggtgagcaactctggacatcccaggcaggagagccatggcgtggccagcactgaagtgtggtcacacctagagccgccaccacaagcaggtcctggaccctcactgggtggtgaccacctcaccctgcgggaggaaggaagccccttctggg

SEQ ID NO: 4583 - DNA, 839 bp, Homo sapiens
  ENST00000423214
ctatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccaggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcgg

SEQ ID NO: 4584 - DNA, 2515 bp, Homo sapiens
  ENST00000473212
cctggggcttaaggaaggcgagaggctcaggccccggacagggatgggagcaggtggcagccagcgcttcttaaactttcaaacttttggtaaagtttagtaaaatacttttgtgagcagttttgggtttaaagaaaagtgagctcaagcttctgaaagtggatgaacacatggcgtgtgaggggctcctggtgggtcatgtcacagtgaacgtttacaaagataaatgtcacctcacacacccgataataagacaaggcgcctgacgggacgaggcggcaggggggctcaggccctccagggccacgtgacgtccacagcacggccccggctggggggcaggctgtcccgtggctctgcaccccgcgttataaacaccaaggtgggatgaaatgcatcctctctgcttagcacgggccttgctcaccagcctggctcctcagacacacctgggattgccccttccaggacaggccagcccctttcctgctttcccaaaatggtctgggtggcaggagtggccgctctgatccaggtgggtgcggccatgcttgcagggccccgggaaggtttaccttcgtgtggcaaaggtgaggacgggtagaagccccatgccgccgaaacggcctgtgacatccgtgggagcctccatggcagaacactgcacactgacacagccctgactcctggagccctcccaccttccaacacacccaccttccttctagagccctcccaccttccctctggaaccctcccaccttccctctggagccctcccaccttccctctagcactccctccctctcgccaccggccccctcctaggcctggccagcccctgcagcaccccagacagtgaatcccactccagtcccttcatctggccagggagaggctgccagtctcatagcagatgctgagctggtgcccactgtgtgccaggtgtgcttgtaggcacccggatgcagccccatcctaactttcaggggctttggtcctgacaggaggaggcaggggatggcatcctagcaaacgcgtgctgggagggctgggtgctgggcagggagggcaacctgccgtggactgggagggctgggtgctgggcagggagggcaccctcctgtgggctgggagggccgggtgttggggagggagaggcgggtgctgggcagggagggcaccctcctgtgggctgggagggccgggtgttggggagggagaggtgggtgctgggcagggagggcaacctgctgtggactgggagggccgggtgctgggcagggagggcaccctcctgtgggctggcagggccgggtgctgggcagggagggcaccctgctgtggactgggagggccgggtgctgggcagggagcgtaccctggcacaggcttggaggggcaggtgctgggcagggagggcaccctcctgtgggctgggagggccaggtgctggggcgggagagtcgggtgctgggcagggagggcaccctggctcaggcccagccgcaggtcctgggtgaccctgctgctttcttccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgt

SEQ ID NO: 4585 - DNA, 6586 bp, Homo sapiens
  ENST00000359759
atggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcaggtagagcttctctctcctccttgctgggcggggcccctccctggggaagcctgcaggacccagacagccaaggactctcgcccgccgcagccgctcccagccagcagctccaacgccctgacgtccgcctgcgcacgccacttctgcaccccctggtgatgggctccctgggcaagcacgcggccccctccgccttctcctctgggctcccgggcgcactgtctcaggtcgcagtcaccactttaaccagggacagcggtgcttgggtctcccacgtggctaactctgtggggccgggtcttgctaataactctgccctgctcggggctgaccccgaggcccccgccggtcgctgcctgcccctgccaccctccctgccagtctgcggccacctgggcatctcacgcttctggctgcccaaccacctccaccacgagagcggcgagcaggtgcgggccggggcacgggcgtgggggggcctgctgcagacgcactgccaccccttcctcgcctggttcttctgcctgctgctggtccccccatgcggcagcgtcccgccgcccgccccgccaccctgctgccagttctgcgaggccctgcaggatgcgtgttggagccgcctgggcgggggccggctgcccgtcgcctgtgcctcgctcccgacccaggaggatgggtactgtgtgctcattgggccggctgcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactg

SEQ ID NO: 4586 - DNA, 6727 bp, Homo sapiens
  ENST00000225964
agcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgactggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgctaaaggcgatgctggtccccctggccctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgtgagggggctcctggtgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcctgtcggccctgttggcgcccgtggccccgccggaccccaaggcccccgtggtgacaagggtgagacaggcgaacagggcgacagaggcataaagggtcaccgtggcttctctggcctccagggtccccctggccctcctggctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 4587 - DNA, 1147 bp, Homo sapiens
  ENST00000510710
ggtccccctggctctgctggtgctcctggcaaagatggactcaacggtctccctggccccattgggccccctggtcctcgcggtcgcactggtgatgctggtcctgttgtatgtagcccctcatcccctctgctcatggccctccagcccccaaagcacttggatgccggtaatccccactctcttccctctctgtgcagggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccaggtgcgtgagctggacctcagagccagtgttaggagatgggctagcccagtgctcagaagggacatgaagtcctggagtaggtctctgctaagggtgatggacagagctgggctgggaggcaggggtctcaggtccctgatagtggttcagacacaggctgccgatgggcaggtggtgcctcctctcgatataacggtgcattgggcagctctctgaggaccctggacagggaggccaggcaggactagaggttcccgcatagcggctcactcttccctctctcccctcccctgcagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaac

SEQ ID NO: 4588 - DNA, 836 bp, Homo sapiens
  ENST00000486572
caagagtggtgatcgtggtgagactgtaagtagctgggctccagttccctgtacctggtcaggccagggactcttcaggcctccttagaggcctggggatgggtgtcggacttcacccaggcagggggaggaaaggagatcctgcaagatgtcagggccttaatccaaaaaactgagttaaagctcagccccaagtcccctctcccagacaggaccgcctctcccatgagttggccccagctcccgtgaagattgcagtggggaggtttccctgggagttgggagagatggccacagtgggaagcagctgaggagagagagatccagcagaggggaggcctcatcctgcagccccagcctcagccttccctggccaagagctcatgctttccttgctctccccagggtcctgctggtcccgccggtcctgtcggccctgttggcgcccgtggccccgccggaccccaaggcccccgtggtgacaagggtgagacaggcgaacagggcgacagaggcataaagggtcaccgtggcttctctggcctccagggtccccctggccctcctgtaagtatgctcagcccctccccagtccccatgctgtgctgtgggataggagggggagcttcgcctcagtttccccctctggatagtcattctttcccctccctagtggggactggggtctgaagatttgtgggcatgtccaagtagcttctgagagggtgaggggtacacagagagggattatgggagaggtctctgcctatggacaccctcgggctagatttccagaataatgaaggggcatgggttgcccacactgcccttgtctc

SEQ ID NO: 4589 - DNA, 789 bp, Homo sapiens
  ENST00000511732
tgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactgtaagtagctgggctccagttccctgtacctggtcaggccagggactcttcaggcctccttagaggcctggggatgggtgtcggacttcacccaggcagggggaggaaaggagatcctgcaagatgtcagggccttaatccaaaaaactgagttaaagctcagccccaagtcccctctcccagacaggaccgcctctcccatgagttggccccagctcccgtgaagattgcagtggggaggtttccctgggagttgggagagatggccacagtgggaagcagctgaggagagagagatccagcagaggggaggcctcatcctgcagccccagcctcagccttccctggccaagagctcatgctttccttgctctccccagggtcctgctggtcccgccggtcctgtcggccctgttggcgcccgtggccccgccgtaagtaccctgctgtgtcccccatgcctttagaactctacagatgcagacagtgccccactcgatgccaatggaacttccgcctgacagtttgtccctttctctcttctagggaccccaaggcccccgtggtgacaagggtgagacaggcgaacagggcgacagaggcataaagggtcaccgtggcttctctggcctccaggg

SEQ ID NO: 4590 - DNA, 396 bp, Homo sapiens
  ENST00000494334
ggtgatgctggtcccaaaggtgctgatggctctcctggcaaagatggcgtccgtggtctgactggccccattggtcctcctggccctgctggtgcccctggtgacaagggtgaaagtggtcccagcggccctgctggtcccactggagctcgtggtgcccccgtaagtacagaagacctgttaagaccccatacttggcccttccctcccttcacacagcacccctggccctgtctgtgccttcaccccttgcctctcccctcaccgcatccccgccttccctcctgtcagcgcatctctccaatctgactccttttcttctagggagaccgtggtgagcctggtccccccggccctgctggctttgctggcccccctgtgagtaccaagaccccc

SEQ ID NO: 4591 - DNA, 600 bp, Homo sapiens
  ENST00000476387
gtgcctcccatccttagggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtccca

SEQ ID NO: 4592 - DNA, 481 bp, Homo sapiens
  ENST00000504289
gcagggaatccagagggacaggcccccgctcctagctaatcagacagccatcaactagagggattgaggttagacgccggaaagaacttcctcccatgaagggagcagcacagagggaagtgggggctgcatgattgctagtctgggtgacttcttttaagagctgctggaatatgctgtgactttccctcaacccttctattgataaatcttggtccatagtttggggaggggggaagcctttgacacatccctaggaggaagagaggggctgtttgggataatctcaattcagtgctgagaaggggttcctctctaatcacggccagaccccaggaggaaggaccgtgctttccagcagagtggccccaggtgggttttgctcactgtctgttcctctctccctccccctcagggtgttcctggagaccttggcgcccctggcccctctggagcaagaggcgagagaggtttccctggc

SEQ ID NO: 4593 - DNA, 614 bp, Homo sapiens
  ENST00000463440
caagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctgtgagtattaagtgaggatccatgaagagccagggacaaacacacctgagacttgaaggagtcctgggctctgggctcagctgtgccgctgacctgccgtgtggccactcactctcactttctggacctcagcctccctatctgtaaaatgaaagacttctcggcggggcacggtggctcatgcctgtaatcccagcactttgggaggccaaggcgggcagaccatgaggtcaggagtttgagaccagtcgggccaacatagtgaaaccacgtctctactaaaaatacaaaagattagctgggtgtggtggtgtgcacctgtaaccccagctagtcaggaggctgaggcaggagaattgcatgaacccgggaggtggaggttgcagtgagctgagatcacgccattgcactccagcctgggcaacagtgcgagattccatctcaaaaaaaaaaaaaa

SEQ ID NO: 4594 - DNA, 1192 bp, Homo sapiens
  ENST00000471344
ggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctgtaagtatcactccccctgaaccccctgccattgtcctgtctgcctccctgctgtcctcactgctgctttcgtgcctcccatccttagggtcccgccggtcaagatggtcgccccggacccccaggcccacctggtgcccgtggtcaggctggtgtgatgggattccctggacctaaaggtgctgctgtgagtattaagtgaggatccatgaagagccagggacaaacacacctgagacttgaaggagtcctgggctctgggctcagctgtgccgctgacctgccgtgtggccactcactctcactttctggacctcagcctccctatctgtaaaatgaaagacttctcggcggggcacggtggctcatgcctgtaatcccagcactttgggaggccaaggcgggcagaccatgaggtcaggagtttgagaccagtcgggccaacatagtgaaaccacgtctctactaaaaatacaaaagattagctgggtgtggtggtgtgcacctgtaaccccagctagtcaggaggctgaggcaggagaattgcatgaacccgggaggtggaggttgcagtgagctg

SEQ ID NO: 4595 - DNA, 403 bp, Homo sapiens
  ENST00000485870
atggtcctccacatccccagagtcccaccatgaatgaatttctcactcattattctctgatctacagggtgagcctggcagccctggtgaaaatggagctcctggtcagatggtgagtgtgcccagttccagagggcagggatggggcaggaggcaggggcaagatggaggcctgggggaacaaggctgtctcccatctcatctgacttctcttggtttggttgtcagggcccccgtggcctgcctggtgagagaggtcgccctggagcccctggccctgctggtgctcgtggaaatgatggtgctactggtgctgccgggccccctgtgagtgtggcctgtaggcctcagggcctgggagtggggaggggtctcagtatctgctcttggggctgacaatggg

SEQ ID NO: 4596 - DNA, 594 bp, Homo sapiens
  ENST00000495677
gcagactgtccctcaatttgggattgtctcattagattagatgcagggatgcatctttgcaggaatgtcttaaaagcaatgttattcttctcagcacatcacaccaggaagtgcatgatgtcagtttcttccatcctcagtgccgtcttctgcctttcaattcactgtcctcactctgacttctcttgtttgttctagaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcct

SEQ ID NO: 4597 - DNA, 640 bp, Homo sapiens
  ENST00000474644
agcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgaggtaatctcctgccctcgaattttgcccctgcgcggcccgtgactcctcacagtcctcccttctctaacctggcctcttgtttcttctcccccaatcccacagggacccaagggagacactggcccccgaggcccaaggggacccgcaggcccccctggccgagatggcatccctggacagcctggact

SEQ ID NO: 4598 - DNA, 549 bp, Homo sapiens
  ENST00000507689
gcggactaaagctttgtttaaattcctgagaactggaaagagttacagcctccctggccaggcgcctcggcgctgtcacccgcgctgatgaggagcaggcgagcttttaaggatttgaggaaagaagaacggggggaggggcgggaagtgaaaaatccaagtgtgcctcttagacccgggggaaaggtggttaagctgggggttgcagtcactactgacaacgcccctcttccgcctgtcccagtcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctgga

SEQ ID NO: 4599 - DNA, 5411 bp, Homo sapiens
  ENST00000297268
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 4600 - DNA, 594 bp, Homo sapiens
  ENST00000488298
gaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaaggtaaaatcttatgttttctatattgctggtttggcccagtctgcctggaataagtagaccctttacaatagaaagataattgtttttcagatttttatttatttccagttctgtgatgacttccctctcagtaaacagcaatccgattccagtggacctgaattattctaaacaaacaaacaatagcaacaaactgtgggggaaaattcagagttcccaaaacataaatgaattagtatgggttgtcactcttttctcctcacgctgtttatgcttttgttttaatctagaaacattgtattcattg

SEQ ID NO: 4601 - DNA, 828 bp, Homo sapiens
  ENST00000473573
agggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctgtaagtaaatcactgtaaacgtgtcttcatttactctagccaaaaggcctggcttctgataggaaactggtaagaaactcttcatgaa

SEQ ID NO: 4602 - DNA, 962 bp, Homo sapiens
  ENST00000497316
catccttaagaggactgaagcaggttatagaggaatcgcagctgtgcactcccactaccctcatctcttcagtcaccatgtcattaacagcatctctctctgctatattctccctcctttcaatagcccagccttctttgtgtttcaaagcaggcaagaagcctgtctagctagctgtttaaattggaattcttctagagtttgattcttcattttcttctttctccactaaaattgatttcacatgtgtttgactcaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgct

SEQ ID NO: 4603 - DNA, 776 bp, Homo sapiens
  ENST00000461525
cctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctgtgagtatttacaatggactctcgccgcttttcttttttcagaatctattaaggacacttgaaagttttgaaatttttggtaaatttggactaccatgaggaaacttttgagattcaagttcattctattcagagcaattccgatattgatgttaacttgaactcagctggaactcagtgtatgttgctatcagctcacttgaggtaataaccaaggtgggccctaggcagtttaattgtaaagtcggaaaaaatattccttttggcgtttattaatatgccccttcttctgcctgaccatgtccttctcctttgcaggcaatgctatcacaacaatt

SEQ ID NO: 4604 - DNA, 713 bp, Homo sapiens
  ENST00000467931
gatacggggtgttattaataagacatgtttcctttttggtactagggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctgtaagttgaattcactggtggtccacacagcagctacccattagatcttccaattaaatatatatccgtcaagtgcctgctatgcaacagggaatataccagatagaagatggaaaataacggaaggattaacatttgcacactgctttacaaagtataaaagtttcatgaatattgttttattttaattctctgataacctcataagggtggtaatattgaagaacattctgacacagatagtcattttttatttctatattttcttctaagagatgcgggaatgatccacttgaagaaaagagtagcatttacaagggtttgtttgtgatttgactccatctttttgtttgcatttagggtccaaatggtccccccggtcctgctggaagtcgtgg

SEQ ID NO: 4605 - DNA, 5993 bp, Homo sapiens
  ENST00000481570
taacagaaaaatcttcattccctgtaggcatttaattaaacctagttgagaagtgtgtgggattcctcaattatgaacaaaacacgtatattggctttctttaaaaaaaaaaaaaaagaagaaaaaagaaaaggcaaagtccttcgaaactcagagtcccattcatttatcattaactcctatcattctacatagttctgattccaatatgccagggtaccagtggcatgacattgtttttcctcatagaaatttgccatagtctctcctccattatttggttggttacagcctcataaaggaagacaggagttgcttctttctgcaagaaagaaggttaaaaactataaatatttcccccaaatggccagggtattattttattgcatcacattgtttgcatcttaagatctagaatctttgctgctctcttccaggcccttggtgattaacagaaaggaaatgaccttgtacatttgctcatagggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctgtaagtgatttccaactcctctttcttaataccttatgctgaattaaaataaagcccctacacaaatcttcaagtggcatctatttgttgatgagtattgcaggctctcaagtagagctcagttgagccaggaaatctgtccagcacacactgaggggctgtggcttccaagatgctcagaaagcacaaaatcgggaagacaataaatgagggaactcagttttatcacaaagcccttaaagctattgaaggcaccttactggtaccaggattagaacagagtcccattgctgtggccatcctactacatattaatcaatctcagtaggctaccaatttcttaaacatacactgtccagtattagtgctactctgaaaggtgcccctattagaccttagaggccaaagtcaaaatttgcttccttttgatatactgattttactgatttcctttttgtttttgttttttgtttttgtttttgtttttttgttttgggatggagttcccctctgttgcccaggctggagtgcagtggcacgatctcagctcactgcgacttccgcctccccagtttaagtaattatcttgtctcagcctcccgagtagctgggactacaggcacacaccatcatgcctagctaatttttgtatttttagtaaagacggggtttcaccatattggtcaggctggtctcgatctcctgacctcaggtgatccacccaccttgacctcctaaagtgctgggattacacatgtgagccaccccacccagcctgatttcctttcctttgtgtatatacccagcagtgtgattgctggatcttatggtagttctatttttagttttttgaggaacccctcctactatgtacaactattatgtatccataacaatttaaatttttttatttgtttccctgcctagaggctataaaaactctatttcaccaccccaagtgtctttataaatctcaaccacatatttttaaatgttgtgccattggtctcaaggatgaatcagatacaaaagtattcatgccaagatgtaaactcaccgtcatcactagagaaaagatatccaaggatatgtcctagtaataggaggtcattagcctttttctaagctgaagacagtttattctcacaatcttcaagccaacctgtgttatcacctagggtcttacccataatactcagtattttttctctatttagggacctcctggcactccaggtcctcagggtcttcttggtgctcctggtattctgggtctccctggctcgagaggtgaacgtggtctaccaggtgttgctggtgctgtggtgagtgcttgacagtattctgactccattaacataagaaaagattttaaaagctgccacttcaaatgtgacagattgatcactgaataacttcacttaagatttttattcatggcattttctttatacagatcacatgtcacttatctaagaagctttaataccaccttacttagacacacactataaagacacagcttaaaattatgcagaatgatttttgttctttccacgcacttaggaatgatacaatctctaattgcgtttactcctctgcaatatgaaatgctggcatcatttatcctgtaggaagaatgaaactctggaagttctgaatcgttccattaaaccttatacgtgacaacaactagaaaccatctcatctccataaaatatatcaactttttgaattcatttcatttgggatactgaatgacacgaggctcactttttacagagcaacatcccgtgattacataaagctggccatctacatgtggagaaggagggcagagatgatactaatgatacttcttaccattgtgtgacccattcacattcaatttaccttcttccttcaaactagaatctcctgagtagggttgttttggaggggaaggttagcattccatcgaataaggggaatgtcattttatcttctctgcctgtttagggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctgtaagtaaactgtagccatctcgcacataaactgatcctgaaggccttcagctcagaaggattttcatattttcactgctattgttccagtatagcctatataatatccatttcccattctctggctaactccatctcactcttggaggtaatgctatttcataccaacatgaaaggtgaggattaagggagatagaaatagacatacaataaaatctcctggtaacaatgtccttcaaccccacttaaaataaacataattagaggaatgactaatattgcactgctgaaataggttgtgaaaaaaaaattgaatataatagacataatgggagaaaagagccccactttacattttcaattttctcaatccggagtccatttaactaaagtttcccattcaatttggaaaaaaaaaaaaaatatgtctcttgacatgtgctctgaaagtgtgattttcctcttctgtctttaaagggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctgtaagtatgatttggggaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttgattattttttactgatgagaacatgcttccgtgtgaagctcaactgaaaatctgctgccatggatgtctctcactgtaacaaaatataaagcctctcctatctcactttcacctttgcagggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctgtaagtaatagtgaaatatgggaatagctttgggaagtgggatggagggggttctaacttagactgcccccaagggggggtctaaaggggggttaaaagaacagaagaatgagagaactaacttatttcataagtaaattcagtttttgtatgtattttatatttatttatttatacgtattaatttcgtacttaaattcagatgataaattcagagtattcttatcagatagtgccttctgaaatgctgaaatgtatactatgtccatgcattgttttttctttagcatgttttttaaatggtaatgtgtgcccagaacttaaaatttcttgagacttcagtggcctaaactataatttatagttatgtgtattttattttacttattagtatggcctacatttaacttttaatgctttttctacaatatgctataaatataagaaaaattaaaattcactaacagcaagactacatacccacccaggtcccgctcccaaagacacacatagagggacatacacacaacaatcctaaaaatgactttgtagagataggtcacttggaatgtgtgttgaaatgttgttggtttttttggtttgtttgtttgtttgttttttgttagactgatagggagcccctcccactaaagacacccttgatactgttatttcaaggatgaacttatttatctgggacagacatcttcagaatgacacatgccaaacagtggttcttattaaatcaaaggttcagatattatcagattcagaaatagtgatgctttgtgtatctattttcttctctttaaacagaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaa

SEQ ID NO: 4606 - DNA, 656 bp, Homo sapiens
  ENST00000469732
tgtacaactattatgtatccataacaatttaaatttttttatttgtttccctgcctagaggctataaaaactctatttcaccaccccaagtgtctttataaatctcaaccacatatttttaaatgttgtgccattggtctcaaggatgaatcagatacaaaagtattcatgccaagatgtaaactcaccgtcatcactagagaaaagatatccaaggatatgtcctagtaataggaggtcattagcctttttctaagctgaagacagtttattctcacaatcttcaagccaacctgtgttatcacctagggtcttacccataatactcagtattttttctctatttagggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttgg

SEQ ID NO: 4607 - DNA, 863 bp, Homo sapiens
  ENST00000478215
attgtgtgaaactttatgtcctgagctgaggttctcttcttccaaatttctgaacaagatggtcagcttctccatagtatctacacctagtactgaaaatatgaaaattgcttaggccaaagaatgggcttttcaatagcacactgcaaaactgggcccaagtatttaaaacatctctaaaaaatatctaggttggcaggtttttatccctagttttaacagtctgaaagagggttcgttactgagcactggaagtgatgaagacagagtagctacaacataggggctggtaggcagcagagcctcaccaacagccttaatttgtgtggtgtcttcacagggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctgtaagtaaactgtagccatctcgcacataaactgatcctgaaggccttcagctcagaaggattttcatattttcactgctattgttccagtatagcctatataatatccatttcccattctctggctaactccatctcactcttggaggtaatgctatttcataccaacatgaaaggtgaggattaagggagatagaaa

SEQ ID NO: 4608 - DNA, 380 bp, Homo sapiens
  ENST00000488121
caaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctgtaagtatgatttggggaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttattta

SEQ ID NO: 4609 - DNA, 599 bp, Homo sapiens
  ENST00000492110
aaacataattagaggaatgactaatattgcactgctgaaataggttgtgaaaaaaaaattgaatataatagacataatgggagaaaagagccccactttacattttcaattttctcaatccggagtccatttaactaaagtttcccattcaatttggaaaaaaaaaaaaaatatgtctcttgacatgtgctctgaaagtgtgattttcctcttctgtctttaaagggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctgtaagtatgatttggggaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttga

SEQ ID NO: 4610 - DNA, 1123 bp, Homo sapiens
  ENST00000464916
gaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttgattattttttactgatgagaacatgcttccgtgtgaagctcaactgaaaatctgctgccatggatgtctctcactgtaacaaaatataaagcctctcctatctcactttcacctttgcagggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtgg

SEQ ID NO: 4611 - DNA, 4523 bp, Homo sapiens
  ENST00000620463
gtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatttttcgaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgc

SEQ ID NO: 4612 - DNA, 4172 bp, Homo sapiens
  ENST00000358894
ataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctgccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 4613 - DNA, 4536 bp, Homo sapiens
  ENST00000479501
gtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctgccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatggtgacgtgggccccgcgtcgcccccagcagtcaggaggagtaggggcagggaggccccagagccctgggaggccttcagaggaagtccagcctccaggccaggccctcagcaccctctgggtgggaggcaggtgtcccgggcagggggctgtgggccacattgagggtcacctccagcttggcaccctcagggctgctcctgtcctgtcgtgggggccgccctgctcaaggtataggcccggctggttgcagcccgttctcacctgctccaccccttccctggcagccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 4614 - DNA, 8097 bp, Homo sapiens
  ENST00000422202
gtcagggagaggacagacggggggacggctgaagggcatggcctcttccctgccacagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctggtgggtcagagtggagagagaccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccagccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacagaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtgcattcattagtactgtgtttgcctgtatttaattaaaacctgattgccattggc

SEQ ID NO: 4615 - DNA, 1204 bp, Homo sapiens
  ENST00000415763
gagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagag

SEQ ID NO: 4616 - DNA, 750 bp, Homo sapiens
  ENST00000455906
gagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggc

SEQ ID NO: 4617 - DNA, 1924 bp, Homo sapiens
  ENST00000471582
ttttcttgtctaatggtgttggtgaatactccagaattttgtcagagaacagtggcagtagcagatactctcattttcttcttggcctaacagaagtgcttctagcatttgaccattaaagtgctgtcctggaagcggagacaggtgcattttgtcatgtggtagtgaagtccatccactcttcttttattagatttaaaacaccaagaatgcacattaaacaagctctagtgctgttatggacataatgaaatgactgtgcgtcttggagctattaattgtaggatatccctaaatactggatgattgctgcatccgtcgaaaatctgacgtggtcgctgaattctcgttatccatgccatgtgctgcagagctcagcttgctgacattttgttttggatttcgcactgatgcttctaaataagactgtcacagttttctttatagtgtttggaacctcagtttgctttgttcaaaagataatttgagtttaaatagcagcagtgtcctctgccccacagggttggatttcccataaaacctgagtctagtgttttggggtccagggcttaagaaagttttctgtctcttccatacagttggcctgtgggggtctctggcttttcctcggtgatttctgcagcgccccccacaccccgttagaacccagagttgggcaggggagggctgggggtgaggttggttggaactggcttcacaggcttggctctgccattctctagctctgcagacccctgctgtgggttctcccagaccctcccagggtgagcagtgagggtgctggggctgcccctgctcctttaatggaggtgtctccatgtcggtctgggtctgaatgcccagagggctgggagggctggctgtgacccagaggggccacaggaggggtggcaagcgtgaccttgtcaggccctacccgctgcctgtgtctccagggagagcccgggccacccggacagatgggaccagaaggtcctggaggccagcagggctcgccggggacccagggccgtgcagtccaggggcctgtggtaggtgtcactccttccctgccctcctgccctgtgccccctccgcttcgctgtccagcccatcttccccctccagggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 4618 - DNA, 1497 bp, Homo sapiens
  ENST00000494913
gacttcctgttgaccgctcagagacttcctgttggccactcagggacttcctattgaccacccagggacttcctattgaccactcagggacttcccatttgttgttggaggcctgttctgagctgggagcttggtgttggtgctagtacaagagagtgtagctaagggctggttctgcacctctcccaaccccacccaggacagacgtggtggaggggaggtggtggggcggcaggctccatggagggtagggggacagacgtgggagatgggggtgtagtgtcccctgggggatgccttggccttcagcagctccatgggcccccccttaggtgggctccaggttcaccaaggagctggggaggtggaagaagacagaagacggcagggaagtgccagcacaggcctgacccgggcccggggcccgggaggggtctgttctctgggcagtgtcccacacccgccatctcccctagcacaaaatctacagccagaggcaagtcctttgtggcacaagttccagccccactcaggactctgctgcagaaccgagcctctcacatgcctgctctcgggtgcaggcgaggaccacaggctcctaggatctgggaatttgggatggggctttcacaccgccactgtggctatcaggctgcctgagtgaggatccacctcagggccatctcacacttgtcacgtgtggtctcaggccatctctgctgacttcttttctcttcccctcctcatcagggactgccagggcccaaaggggaacgaggagagaagggcgagccgcagtcccttgccaccctctaccagcttgtgagccaggcctgtgagtctgccattcagagtgagtgaggccagcagccctgcacctgtgcctaccacacctgtctgtcctcacactggccaggccgagggaggccgccttcacccatcgttagcacacctgggccaggtgtcctggcgtggcctgcacaggcctcgcatccccgggtccccactgtgtcctgctgacacccctcctccccacagcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 4619 - DNA, 723 bp, Homo sapiens
  ENST00000496810
acagacgtctcaggaaactgggggcaacctggggggagccccgtgggctgtgggaacccctgcccccggcttggaagctgcccacagtggcctggttgcagcctggcagatgaggggtacatcactactcagaataaacggccccctctgcacccacctgtctagatgagggtgacaggcactatcacagggcccccacctgacgccttcccacctggccatgcccccccagaactgtcatggagcccaggaggcgcctgtgtggagcacggggacctggcacgctgctgcccctagatctcagactcccatctaaggaccagacctgctgcctgtgcccagggaggggccctgacaccctctgtccccgtcagaacagggccccaagccactgcattgctccgtcctcacatgccctccctttcctcgcaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 4620 - DNA, 3584 bp, Homo sapiens
  ENST00000341807
ctgcattctggctgcaaaaacagctcctggtttgaaacaacttaatggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccgggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaaaggactctggaaagccagaagactgcagtggatttctgaaacttgaactcagagcccagtgggaagccagaggtcttgaaagacttcagccatgtgttccttttttttttctttcttttatcgtttgctttttgttttattttcttgagagacctcaaaattattaaatccaacagacgctgccggtcggtcagattattattaatattattgttgttgttaattattattattatttcatatgctgatgctttgtgagttcttttccactcctttaaagttgggaaaacttgattcgtggggcaggagattgtttcttcattcttctgacagcccccatctgacgcgtaactgcccattttaaggaaactcttggtgctacaaaaccctgaccagacacttggcaaatttacctctttcttcaaaagaaaaactttaagaaaatgagccaatgggcttcattctcagtcatgcccggagatcacccaggagaaataatacaaacaccaccactgtccagagagagtaaagaagcagaaagagaaagaatttgcaaccatgaggaatgttcccacctcccgacgggacgtgcatttggaaaacacagaatcagccctcagggtgcactccagccacctcagtgctctaagctcacagaagtgaaataatgtctgtgggttggcaatggctttgtgggatcatatgtcttggccaaagatgggaaaacctatgttgaagaggcagcccttgagtgttaatttgtcttctaaactgtgtaaggccccttcaagttcctcttgttggtttcaattatattaattataaaacaagtggatgtggtgaccatccacttgtgtttccctaatgatgggcagttggccagggcactgaccagagctgggaaatttgtatctccaaggcggctctgtctctgaaataaatggcatcaagtgcatgtgtgtatgcgacatgccctgcctgaacaggtgctcaataaatccaagtttccttctcttga

SEQ ID NO: 4621 - DNA, 6346 bp, Homo sapiens
  ENST00000303045
ggggctggccgaggctgcggcgtttctccccaaggaagtgtcttctccgctttccctgttcttctgtttctcacacactttctatctcattctgtaactttcaagcctttccttctaactgtatgtatttagttacttgttttcaagctggttccctctctggccccctggcctggggaaagcctccacacttactgcgggtcttgtttagagtctgagtttgtgagattatttgggggagagtgggcgagtggctgacaggtgacccccaggaggaggattcctggggctggtgtcttctcccagctgctgcttccagtgggcctgggcccaggactggacctccgctggcacccctgagtgcctccctgccaggccatgctgctgtagaccctaacagcgtctcttcctggccaagagaagcctgtccccaagaacaggagagccatggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctgagcatccaggcccagaacgtctccctgcacattgactgtgcgctggtgcagacactacccatcgaggaacgggagaacattgacatccagggcaagactgtgattggcaagcgcctctacgacagtgtgcccattgactttgacctacagcggattgtgatctattgtgactcgagacacgcagaattggagacttgttgtgatatcccctcgggtccgtgccaggtgaccgtggtgacagagcctccacctccacccccaccccagcggcctcccaccccaggcagtgaacagattgggtttttgaagaccatcaactgctcctgcccagctggagagaagggtgaaatgggagttgctggccccatggggctccctggtccaaagggagacataggagccattgggccggttggcgctcctggacctaagggagagaaaggtgatgtgggcataggaccttttggccaaggggaaaagggtgaaaagggttccctgggcctgcccggcccccctgggagagacggcagcaaaggcatgagaggggagccaggagagctgggagagccggggctgccgggtgaggtcggcatgcgggggccccaaggaccacctggactccccggacctcctggacgtgtcggagctcctggtctccaaggagaacgaggtgaaaagggaactcgaggagaaaagggagagcgaggcctggatggattccctgggaagcctggggacacaggacagcagggcaggcccggcccttctggtgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaaggctgcttgcggaaaagtcagagggtcagaaaactgtgcactgggagggcaatgtgttaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccgggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaaaggactctggaaagccagaagactgcagtggatttctgaaacttgaactcagagcccagtgggaagccagaggtcttgaaagacttcagccatgtgttccttttttttttctttcttttatcgtttgctttttgttttattttcttgagagacctcaaaattattaaatccaacagacgctgccggtcggtcagattattattaatattattgttgttgttaattattattattatttcatatgctgatgctttgtgagttcttttccactcctttaaagttgggaaaacttgattcgtggggcaggagattgtttcttcattcttctgacagcccccatctgacgcgtaactgcccattttaaggaaactcttggtgctacaaaaccctgaccagacacttggcaaatttacctctttcttcaaaagaaaaactttaagaaaatgagccaatgggcttcattctcagtcatgcccggagatcacccaggagaaataatacaaacaccaccactgtccagagagagtaaagaagcagaaagagaaagaatttgcaaccatgaggaatgttcccacctcccgacgggacgtgcatttggaaaacacagaatcagccctcagggtgcactccagccacctcagtgctctaagctcacagaagtgaaataatgtctgtgggttggcaatggctttgtgggatcatatgtcttggccaaagatgggaaaacctatgttgaagaggcagcccttgagtgttaatttgtcttctaaactgtgtaaggccccttcaagttcctcttgttggtttcaattatattaattataaaacaagtggatgtggtgaccatccacttgtgtttccctaatgatgggcagttggccagggcactgaccagagctgggaaatttgtatctccaaggcggctctgtctctgaaataaatggcatcaagtgcatgtgtgtatgcgacatgccctgcctgaacaggtgctcaataaatccaagtttccttctcttga

SEQ ID NO: 4622 - DNA, 697 bp, Homo sapiens
  ENST00000487854
ggccatcacagttgactctgaggcaggagccaggctatgtacaccctctatcacaaagacctacaagggaggactgtcccaaatttacagatccagagatccggagaaaggaaatggcactttaagatcacacagctaaactaagaaacagacaaacctggaagtcagggctttaggccccacccttctttctatagttttttttttttttctaaatccaaggatgttcctttctctccccactccccaataatgggctgcatatgatttccaaggtttaaaacttgtaaacatgaggtggacagaaggtttgggaacagggcaatgccaagctgtgggcagtaaagaattttaaatagcaagagtgtcctgacaagctcttttaagatgatggggtgaggaaaaggctgtgtacgtcacaggtcgccctgccagtagggcaaagcaggagagccaggtctaccaggaccagagggtgcccgaggcccacctggcttcaagggacacacaggcgattctggtgcacccggtccccgggtaaagtctggtgccatggggcttcctggtcaggaagggttaccaggaaaagatggtgacactggacccactgggccacagggtccccaaggaccaaggggcccaccgggcaagaatggatcaccgggatctccaggagagcctggcccttcaggaaccc

SEQ ID NO: 4623 - DNA, 554 bp, Homo sapiens
  ENST00000522546
ggggagccaggagagctgggagagccggggctgccgggtgaggtcggcatgcgggggccccaaggaccacctggactccccggacctcctggacgtgtcggagctcctgtaagtgaaggcacttgtctgggcaggggttctaccccttctccaggaatcaaaaaccaggttctagcaagttcctccacctgcatctagacagtaatgctgttttgccttactgatgccaatgaagtgttggtatctcctttcttagaccagaaattattagatgttacagtccataagaatcacccagagaacaagtttaaatgcatattcctgggacccctttctcacatcaagaagcagggtagatcccaggaatctgcatttttaaccagcaccacaggatttttgacacttgatctaaagaattcattttccccagcctgtcctgtactgtactcttgtaagaagggtggagtctactgaattcttagcccctggaacagtgccagactgtccagtatggtgttcagtatgtccagtgaataaagagatgaacaaacaga

SEQ ID NO: 4624 - DNA, 661 bp, Homo sapiens
  ENST00000517515
gatttgtcagtgtttcctcaccagggacctcacgaggaaaacatggggaggatggagagctggaagacagggcacaaatcccattcgtgagctttctgccctcaagacctaatcacccgccaccaaaaccccatctgctgttaccatcaccttggtgtgaagatttcaacatatggatttaggaagacagcaacattcagaccatggcatcctggcatctgggacagggcaccaagcaggataagggatgtgttcccccaaggtttacctgatgagtacgcctttgtcacaaccttccggttcaggaaaacctctcggaaggaagactggtatatctggcaggtcatcgaccagtacagcatcccacagctttcagttcccatgaaggtaggacagctctccaccagcacacagtccggtgaggaaagagaaatctgaaattcaaagccatcaacaccatctgttggtttgagataaaagcaacactactatttgttctctgccaaatccaaatccccttgttctcaagtcatagacaaaccgtttctttctcctctcctagtaaaatgaactggatgaagatattactcacttttcagctgggagatactgactaaactttcactgggggctaaaataaaataaaagcatgctcaagcaa

SEQ ID NO: 4625 - DNA, 572 bp, Homo sapiens
  ENST00000484387
cctgggcagtggcggggctggccgaggctgcggcgtttctccccaaggaagtgtcttctccgctttccctgttcttctgtttctcacacactttctatctcattctgtaactttcaagcctttccttctaactgtatgtatttagttacttgttttcaagctggttccctctctggccccctggcctggggaaagcctccacacttactgcgggtcttgtttagagtctgagtttgtgagattatttgggggagagtgggcgagtggctgacaggtgacccccaggaggaggattcctggggctggtgtcttctcccagctgctgcttccagtgggcctgggcccaggactggacctccgctggcacccctgagtgcctccctgccaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagtt

SEQ ID NO: 4626 - DNA, 4355 bp, Homo sapiens
  ENST00000435777
cctggccaagagaagcctgtccccaagaacaggagagccatggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccgggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaaaggactctggaaagccagaagactgcagtggatttctgaaacttgaactcagagcccagtgggaagccagaggtcttgaaagacttcagccatgtgttccttttttttttctttcttttatcgtttgctttttgttttattttcttgagagacctcaaaattattaaatccaacagacgctgccggtcggtcagattattattaatattattgttgttgttaattattattattatttcatatgctgatgctttgtgagttcttttccactcctttaaagttgggaaaacttgattcgtggggcaggagattgtttcttcattcttctgacagcccccatctgacgcgtaactgcc

SEQ ID NO: 4627 - DNA, 3061 bp, Homo sapiens
  ENST00000390654
agaggtgcgcgctgcgcgtgggatcagcccggcgccgacgggtggctccgaggagctcgctccttcctcgcccccgccccctcgccgcgcggggccagcccggccgctcctcccctgggtgggtccctgctccttttctggcagggtctatttgcatagaggaaactgcccaaagtggccgctgtggaggagctggctgcggcgaagggggcgtgcgcggcgatccgctgctacccggaggctaacccccgcgcccggcggacctcgtgcctcgggctgtcccgcctgctcctctcgcacccagcctctgccccagcagcaccgccccctcggagagtccacgcgcgacgaacgcgccatgggcccaggcgagcgcgccggtggcggcggcgacgcggggaagggcaatgcggcgggcggcggcggcggagggcgctcggcgacgacggccgggtcccgggcggtgagcgcgctgtgcctgctgctctccgtgggctcggcggctgcctgcctgctgctgggtgtccaggcggccgcgctgcagggccgggtggcggcgctcgaggaggagcgggagctgctgcggcgcgcggggccgccaggcgccctggacgcctgggccgagccgcacctggagcgcctgctgcgggagaagttggacggactagcgaagatccggactgctcgggaagctccatccgaatgtgtctgccccccagggccccctggacggcgcggcaagcctgggagaagaggcgaccctggtcctccagggcaatcaggacgagatggctacccgggacccctgggtttggatggcaagcccggacttccaggcccgaaaggggaaaagggtgcaccaggagactttggcccccggggagaccaaggacaagatggagctgctgggcctccggggccccctggacctcctggggcccggggccctcctggcgacactgggaaagatggccccaggggagcacaaggcccagcgggccccaaaggagagcccggacaagacggcgagatgggcccaaagggacccccagggcccaagggtgagcctggagtacctggaaagaagggcgacgatgggacaccaagccagcctggaccaccagggcccaagggcgagccagggagcatggggcctcggggagagaacggtgtggacggtgccccaggaccgaagggggagcctggccaccgaggcacggatggagctgcagggccccggggtgccccaggcctcaagggcgagcagggagacacagtggtgatcgactatgatggcaggatcttggatgccctcaaggggcctcccggaccacaggggcccccagggccaccagggatccctggagccaagggcgagcttggattgcccggtgccccaggaatcgatggagagaagggccccaaaggacagaaaggagacccaggagagcctgggccagcaggactcaaaggggaagcaggcgagatgggcttgtccggcctcccgggcgctgacggcctcaagggggagaagggggagtcggcgtctgacagcctacaggagagcctggctcagctcatagtggagccagggccccctggcccccctggccccccaggcccgatgggcctccagggaatccagggtcccaagggcttggatggagcaaagggagagaagggtgcgtcgggtgagagaggccccagcggcctgcctgggccagttggcccaccgggccttattgggctgccaggaaccaaaggagagaagggcagacccggggagccaggactagatggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgcccccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcgaggatggaggggcccagcctggactgactgctacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtgtc

SEQ ID NO: 4628 - DNA, 568 bp, Homo sapiens
  ENST00000484750
agcggcagcaacctgcgtgggtccctcaccttgtgggagctttgttcttttgctcttcacaataaatctccttgctgctcactctttgtgtcagtgtcatctttaagagctgtaacactcaccaggaaggatctgcttcgctctctgcgcctcttgttgcccgtctgtaaaatgaggctgaaatggcaggtggagtggaactgtgaagcgcctttccggtggctggaggtgccctggtgaagtctcccggtcctgggctgttccagtcagaggcagacagggcctggctgagaagttggacggactagcgaagatccggactgctcgggaagctccatccgaatgtgtctgccccccagagtgtgcaggtttacatatgctgttcggttggtgatggaaacacttacggccactgataaagcaataaatgaaaggaaatgacaggaaagcaccatcctcgagcttccatggacacagagatgaagatttccatctgtggctagacaggcgcagagctttggaggtgctcctggcccgtcggttcccagtgacgtgtcttcaactccag

SEQ ID NO: 4629 - DNA, 2329 bp, Homo sapiens
  ENST00000407622
tgttttcctgtctagggccccctggacggcgcggcaagcctgggagaagaggcgaccctggttttccagggacccctgggtttggatggcaagcccggacttccaggcccgaaaggggaaaagggtgcaccaggagactttggcccccggggagaccaaggacaagatggagctgctgggcctccggggccccctggacctcctggggcccggggccctcctggcgacactgggaaagatggccccaggggagcacaaggcccagcgggccccaaaggagagcccggacaagacggcgagatgggcccaaagggacccccagggcccaagggtgagcctggagtacctggaaagaagggcgacgatgggacaccaagccagcctggaccaccagggcccaagggcgagccagggagcatggggcctcggggagagaacggtgtggacggtgccccaggaccgaagggggagcctggccaccgaggcacggatggagctgcagggccccggggtgccccaggcctcaagggcgagcagggagacacagtggtgatcgactatgatggcaggatcttggatgccctcaaggggcctcccggaccacaggggcccccagggccaccagggatccctggagccaagggcgagcttggattgcccggtgccccaggaatcgatggagagaagggccccaaaggacagaaaggagacccaggagagcctgggccagcaggactcaaaggggaagcaggcgagatgggcttgtccggcctcccgggcgctgacggcctcaagggggagaagggggagtcggcgtctgacagcctacaggagagcctggctcagctcatagtggagccagggccccctggcccccctggccccccaggcccgatgggcctccagggaatccagggtcccaagggcttggatggagcaaagggagagaagggtgcgtcgggtgagagaggccccagcggcctgcctgggccagttggcccaccgggccttattgggctgccaggaaccaaaggagagaagggcagacccggggagccaggactagatggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgcccccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcgaggatggaggggcccagcctggactgactgctacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtg

SEQ ID NO: 4630 - DNA, 4630 bp, Homo sapiens
  ENST00000494183
gagcggccactgttggggccctcgaaagaggtgtcggtcctctgggagtcggaagagctgtctgggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccagggagccaatggaatgaaaggagaaaaaggagattctggaatgccgggtccacagggtccttctatcataggcccaccaggcccaccaggtccccatggcccacctggccccatgggacctcatggacttcctggaccaaagggagcatctggcttagacggaaagccaggatcccggggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggggaaaagggaaagaaaggcaaaaaggggcctaaaggggagaaaggagaacagggtgctcctggattagatgcaccctgcccgttggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctccttatcttatgtgaagatacgtatttatatggacaaatcagtggtagagaatgattgattgtactagctattttccttcttttggcttgctaattgcatggacaaaaagtgccatgaaatagtttacatgaaatggtgaccaaatatggactcaaagctatgaaaatgtactatactgactgattttagagctgattatcacattcccattcacctttcatgtcggcgttgactcatacctacaccacccattgaaactaactaaaaaagcatgactgtgtgccaaacctgcttgctgtgcaacttcagatgctagcatgttgatcaggagtcctttgattacatctgaacctttattccttttgtcatctcaagggggttacaccatggcttattgccaaaaagagataaggtggcggagagcacacacacaatttgtcttgtattttgagggagttgcagtcctgactgcagatctacagcttccagtattgtgggctcatgtggccactttggttgaaatacgaaggggttgagcctgttgctgccaccagttttccttgggctgcccttggcagtgaagacatgggaagaggaccgattcagcctccagcactgcctctcatgtgaccaagtaggaaagaggtttacaaatgcaaacatgcagaaccacagactttaaaaatatgtataaataaactgaatttcagcaagtgttaatataggtgcttttaaaaatgacagaggcacagcacttcttttggaataggagattcttggaatgggagatcctgtccctgagggaaaagggatgtccatcccaccaaaacttgggttgctgaagaaataacatgttctgagaagggatcagccaaaatcgcctctcccgatgatataggagagcttactgggacaatctgtgccaaagttgttgtgagagctttccttcctcctacgatccaaccatgtcaaacatttcctacaaagtttgagaaacagaccaaatctaagatctcagaaagctgtgaaatatagttgccataaagaaaatatttttcatctacttgctcaaactttacctaaccatattagatggaacatttctttgcacagtaaagagttggtagcgtgttttgaaatggcttattctaagtggaagtgttacattgaaagaaacattatcaatgaggagtaggcaccctttcagcccattagagaatttaatttctctcctgactcaatgccatcttctgggaagatttctagtttcatgcataggtgtcaccaccagaagggaaattaactcatccttggcttatagttaagatataaccataagacaaggaacctaaaatcctcatgatctcatttatgttatgtaaccaaatgacagtcatacaaaatggcatcttcttttttttctattaaatttttaaggttgaaagatgtttaaactattagatcagtctaattggtaacatttctggtaacattccacacccctaagccagtttagcattttgaaaataatggaggacattttctaacaatttcttgtatggcatggtgttaggataacgtattgctcaatgtctgacacaatttgtcttaaatggtttggaaaaatgaactgaagtgggtggaactacattctcttcaggaaaacaaactacagtgtccagtggctatatttttttcccttctatctttttttctgctcctctagtagaaagaggtggattgaaatggatcactatttaaaacttgcacagcttcaggagacgatacctcaacatcaaaagaaaaacactttatgtataaaaaaattttttgaaatacagcccttcaaagaatactattctgtcctgtgtgtatattgagtttttgctctataactgatttgacaacatcaacttatttcatgattaaatgaggttgtaaactttcattacatttatttccttgggaaaaacaaagggatggaaatactcctccttgttcagtggaattgctaggtcttaaccatgatggataatctttaacttttggttactacaatgttttcaagcatccattttgtcatatagagaattcttaaataatttctaagtgaatgaaagaattgtgtttgttgatatgtgttgatagataatatactttccttaaagatttctttaatgtgtgttattggatagagggttgagaaaatatacatgaaagacacattggaaataaggcaaggtcagtttctatttctaataaaacattgaaggatagcaaattgatatgtgttttagatttaaaattgtttttcatttatgttggttggtgctaatgtatctcttttcctttttctctatggacaatacaactactatggataattttatttccctgtttaatagcattcctaaatcattagtgtgttattttatttttaaagttcatgaatttgctataattatggtccaatgaccaggctttcttaatgtaaaacaaaacagtgtaccaatagatgatgtgtgtttactcgga

SEQ ID NO: 4631 - DNA, 316 bp, Homo sapiens
  ENST00000512961
tggtccacggggtgagaagggtgatctaggagaaaagggagaaaaggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctcctta

SEQ ID NO: 4632 - DNA, 2724 bp, Homo sapiens
  ENST00000399132
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctcctta

SEQ ID NO: 4633 - DNA, 2500 bp, Homo sapiens
  ENST00000399127
gagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggtccgtatccgctcgtgggcttgactccaccaactagttgtgcagccacagggactgaactttggaggaatcgacctttttctttccttttaggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggggcctgccaggcttccccacagttgctgccctgcacagtaatcagatcctcaccgtcaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaagggggatcgtggagaaaaaggggactctggagctcagggaccaaggggtccacctggtcaaaaaggggatcaaggagccactgagatcatagactacaacggcaacctccacgaagccttacagggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtgaaccagggttaaatggtgttaaaggattgaagggtgaaccaggtcaaaagggtgacagaggaccccttggtcttccaggagcatctggcttagacggaaagccaggatcccggggtacagatggtcctatgggaccccatggccctgcaggtcccaaaggagaaagaggtgaaaaaggagctatgggagagcctggaccaagagggccctatgggctgcctggcttccctggtccacggggtgagaagggtgatctaggagaaaagggagaaaaggtgacctctccatcccagcatgtaccttgtttgattcttctcctgctgtctgctttgctgttcagcttgtgtgattccatttgacacttaatctttctccatcctgtgctccaaaaacatactgatgcctgatttaaggaatcaggtcttcagagaggaatgaagaaggctgtactgccagatataagggcactgcctggcatagaagaaaaaattattatcaccagatattctagctacagtttttcaaccacctgacaccaatttatggaaaaataaaggatttttgaaaaaaaaa

SEQ ID NO: 4634 - DNA, 2674 bp, Homo sapiens
  ENST00000399126
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaaggtgacctctccatcccagcatgtaccttgtttgattcttctcctgctgtctgctttgctgttcagcttgtgtgattccatttgacacttaatctttctccatcctgtgctccaaaaacatactgatgcctgatttaaggaatcaggtcttcagagaggaatgaagaaggctgtactgccagatataagggcactgcctggcatagaagaaaaaattattatcaccagatattctagctacagtttttcaaccacctgacaccaatttatggaaaaataaaggatttttgaaaaaaaaa

SEQ ID NO: 4635 - DNA, 448 bp, Homo sapiens
  ENST00000505377
ggaaaaagatataattaaatatgatatgcagcttttcgtgtgtgcctttcattgaaacatgcagttatatacttcatcctttttgcatgagtttcttgaaaaccgctggcctgaaataatcaagcataaagcactttgaaaggagatgagttgtcttactgatattcttaggcaccattcacctaggaaaaatccaggataaattataactgctattcttgcagcccttgtgatatatctcatattatcttttttttagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaag

SEQ ID NO: 4636 - DNA, 428 bp, Homo sapiens
  ENST00000505591
gatccttcgggcagccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaag

SEQ ID NO: 4637 - DNA, 4799 bp, Homo sapiens
  ENST00000610288
caggccctccagggaaacgaggtaagagaggccgaagaggagaatctggtaagtctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccagggagccaatggaatgaaaggagaaaaaggagattctggaatgccgggtccacagggtccttctatcataggcccaccaggcccaccaggtccccatggcccacctggccccatgggacctcatggacttcctggaccaaagggagcatctggcttagacggaaagccaggatcccggggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctccttatcttatgtgaagatacgtatttatatggacaaatcagtggtagagaatgattgattgtactagctattttccttcttttggcttgctaattgcatggacaaaaagtgccatgaaatagtttacatgaaatggtgaccaaatatggactcaaagctatgaaaatgtactatactgactgattttagagctgattatcacattcccattcacctttcatgtcggcgttgactcatacctacaccacccattgaaactaactaaaaaagcatgactgtgtgccaaacctgcttgctgtgcaacttcagatgctagcatgttgatcaggagtcctttgattacatctgaacctttattccttttgtcatctcaagggggttacaccatggcttattgccaaaaagagataaggtggcggagagcacacacacaatttgtcttgtattttgagggagttgcagtcctgactgcagatctacagcttccagtattgtgggctcatgtggccactttggttgaaatacgaaggggttgagcctgttgctgccaccagttttccttgggctgcccttggcagtgaagacatgggaagaggaccgattcagcctccagcactgcctctcatgtgaccaagtaggaaagaggtttacaaatgcaaacatgcagaaccacagactttaaaaatatgtataaataaactgaatttcagcaagtgttaatataggtgcttttaaaaatgacagaggcacagcacttcttttggaataggagattcttggaatgggagatcctgtccctgagggaaaagggatgtccatcccaccaaaacttgggttgctgaagaaataacatgttctgagaagggatcagccaaaatcgcctctcccgatgatataggagagcttactgggacaatctgtgccaaagttgttgtgagagctttccttcctcctacgatccaaccatgtcaaacatttcctacaaagtttgagaaacaggtatttttcattctttttaatgcttttttctttttctttctttagtcccaagaatattgaaaaaatattagtttcagtttttgtcacatatgttttgaacaatttttttaagaagtcttcaaatcataataatttggctccagtagtcaaaatgaccttttactaacttctctcttgttttggataattggatagaatataaaagaagctccactttcagtctaatcattgtaaagcatgaaagttatgcatttttaagtagttttgactttttttacatgatgaatgtaacgtacatggagattatcagttaatataaagccaagattttgtcacatttggtaatattaactaatttctatttttatggttttaagttttgtctatatttagatttctttctctttttaacatttctaaatgtttgtctcatcctcatatccacagaccaaatctaagatctcagaaagctgtgaaatatagttgccataaagaaaatatttttcatctacttgctcaaactttacctaaccatattagatggaacatttctttgcacagtaaagagttggtagcgtgttttgaaatggcttattctaagtggaagtgttacattgaaagaaacattatcaatgaggagtaggcaccctttcagcccattagagaatttaatttctctcctgactcaatgccatcttctgggaagatttctagtttcatgcataggtgtcaccaccagaagggaaattaactcatccttggcttatagttaagatataaccataagacaaggaacctaaaatcctcatgatctcatttatgttatgtaaccaaatgacagtcatacaaaatggcatcttcttttttttctattaaatttttaaggttgaaagatgtttaaactattagatcagtctaattggtaacatttctggtaacattccacacccctaagccagtttagcattttgaaaataatggaggacattttctaacaatttcttgtatggcatggtgttaggataacgtattgctcaatgtctgacacaatttgtcttaaatggtttggaaaaatgaactgaagtgggtggaactacattctcttcaggaaaacaaactacagtgtccagtggctatatttttttcccttctatctttttttctgctcctctagtagaaagaggtggattgaaatggatcactatttaaaacttgcacagcttcaggagacgatacctcaacatcaaaagaaaaacactttatgtataaaaaaattttttgaaatacagcccttcaaagaatactattctgtcctgtgtgtatattgagtttttgctctataactgatttgacaacatcaacttatttcatgattaaatgaggttgtaaactttcattacatttatttccttgggaaaaacaaagggatggaaatactcctccttgttcagtggaattgctaggtcttaaccatgatggataatctttaacttttggttactacaatgttttcaagcatccattttgtcatatagagaattcttaaataatttctaagtgaatgaaagaattgtgtttgttgatatgtgttgatagataatatactttccttaaagatttctttaatgtgtgttattggatagagggttgagaaaatatacatgaaagacacattggaaataaggcaaggtcagtttctatttctaataaaacattgaaggatagcaaattgatatgtgttttagatttaaaattgtttttcatttatgttggttggtgctaatgtatctcttttcctttttctctatggacaatacaactactatggataattttatttccctgtttaatagcattcctaaatcattagtgtgttattttatttttaaagttcatgaatttgctataattatggtccaatgaccaggctttcttaatgtaaaacaaaacagtgtaccaatagatgatgtgtgtttactcgga

SEQ ID NO: 4638 - DNA, 4819 bp, Homo sapiens
  ENST00000622134
caggccctccagggaaacgaggtaagagaggccgaagaggagaatctggtaagtctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatggcaaaaggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacaggcaagtaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctccttatcttatgtgaagatacgtatttatatggacaaatcagtggtagagaatgattgattgtactagctattttccttcttttggcttgctaattgcatggacaaaaagtgccatgaaatagtttacatgaaatggtgaccaaatatggactcaaagctatgaaaatgtactatactgactgattttagagctgattatcacattcccattcacctttcatgtcggcgttgactcatacctacaccacccattgaaactaactaaaaaagcatgactgtgtgccaaacctgcttgctgtgcaacttcagatgctagcatgttgatcaggagtcctttgattacatctgaacctttattccttttgtcatctcaagggggttacaccatggcttattgccaaaaagagataaggtggcggagagcacacacacaatttgtcttgtattttgagggagttgcagtcctgactgcagatctacagcttccagtattgtgggctcatgtggccactttggttgaaatacgaaggggttgagcctgttgctgccaccagttttccttgggctgcccttggcagtgaagacatgggaagaggaccgattcagcctccagcactgcctctcatgtgaccaagtaggaaagaggtttacaaatgcaaacatgcagaaccacagactttaaaaatatgtataaataaactgaatttcagcaagtgttaatataggtgcttttaaaaatgacagaggcacagcacttcttttggaataggagattcttggaatgggagatcctgtccctgagggaaaagggatgtccatcccaccaaaacttgggttgctgaagaaataacatgttctgagaagggatcagccaaaatcgcctctcccgatgatataggagagcttactgggacaatctgtgccaaagttgttgtgagagctttccttcctcctacgatccaaccatgtcaaacatttcctacaaagtttgagaaacaggtatttttcattctttttaatgcttttttctttttctttctttagtcccaagaatattgaaaaaatattagtttcagtttttgtcacatatgttttgaacaatttttttaagaagtcttcaaatcataataatttggctccagtagtcaaaatgaccttttactaacttctctcttgttttggataattggatagaatataaaagaagctccactttcagtctaatcattgtaaagcatgaaagttatgcatttttaagtagttttgactttttttacatgatgaatgtaacgtacatggagattatcagttaatataaagccaagattttgtcacatttggtaatattaactaatttctatttttatggttttaagttttgtctatatttagatttctttctctttttaacatttctaaatgtttgtctcatcctcatatccacagaccaaatctaagatctcagaaagctgtgaaatatagttgccataaagaaaatatttttcatctacttgctcaaactttacctaaccatattagatggaacatttctttgcacagtaaagagttggtagcgtgttttgaaatggcttattctaagtggaagtgttacattgaaagaaacattatcaatgaggagtaggcaccctttcagcccattagagaatttaatttctctcctgactcaatgccatcttctgggaagatttctagtttcatgcataggtgtcaccaccagaagggaaattaactcatccttggcttatagttaagatataaccataagacaaggaacctaaaatcctcatgatctcatttatgttatgtaaccaaatgacagtcatacaaaatggcatcttcttttttttctattaaatttttaaggttgaaagatgtttaaactattagatcagtctaattggtaacatttctggtaacattccacacccctaagccagtttagcattttgaaaataatggaggacattttctaacaatttcttgtatggcatggtgttaggataacgtattgctcaatgtctgacacaatttgtcttaaatggtttggaaaaatgaactgaagtgggtggaactacattctcttcaggaaaacaaactacagtgtccagtggctatatttttttcccttctatctttttttctgctcctctagtagaaagaggtggattgaaatggatcactatttaaaacttgcacagcttcaggagacgatacctcaacatcaaaagaaaaacactttatgtataaaaaaattttttgaaatacagcccttcaaagaatactattctgtcctgtgtgtatattgagtttttgctctataactgatttgacaacatcaacttatttcatgattaaatgaggttgtaaactttcattacatttatttccttgggaaaaacaaagggatggaaatactcctccttgttcagtggaattgctaggtcttaaccatgatggataatctttaacttttggttactacaatgttttcaagcatccattttgtcatatagagaattcttaaataatttctaagtgaatgaaagaattgtgtttgttgatatgtgttgatagataatatactttccttaaagatttctttaatgtgtgttattggatagagggttgagaaaatatacatgaaagacacattggaaataaggcaaggtcagtttctatttctaataaaacattgaaggatagcaaattgatatgtgttttagatttaaaattgtttttcatttatgttggttggtgctaatgtatctcttttcctttttctctatggacaatacaactactatggataattttatttccctgtttaatagcattcctaaatcattagtgtgttattttatttttaaagttcatgaatttgctataattatggtccaatgaccaggctttcttaatgtaaaacaaaacagtgtaccaatagatgatgtgtgtttactcgga

SEQ ID NO: 4639 - DNA, 6532 bp, Homo sapiens
  ENST00000375820
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 4640 - DNA, 593 bp, Homo sapiens
  ENST00000467182
ggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgagtcgagcatctgtaggaacaaatgcaaaattgaagaggaaaagtctctagtctggacaagcatatgttttctatttttctccaaaacgttgaatccattgccatttagcttattatttgtgatattcgagttttgtaatggaaatctaccataaaaattatttgacataa

SEQ ID NO: 4641 - DNA, 581 bp, Homo sapiens
  ENST00000474391
ttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggtaagaagcctgcagatccatgcattcattcagtgtaggtgtgttgagtgccttcggtgtgcagtgctggactcgcctctgctgctgcagtgagggcagtagcgagtgaaacactgcgccatgagggcggtagccagtgaaaaagcagcccggccccatttccctccattgattacaaataatcggttcaacagctgctgtattactaatggcaagccaagaaatgtggagactgaatcttcgaaaatctttaaattaataaaactttagat

SEQ ID NO: 4642 - DNA, 2547 bp, Homo sapiens
  ENST00000543140
cgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccattgctttttcaaatccataaatgaaatatccggatcacattgacatgaaacctttcaatggaacaaaataccagcttcttagcttttgtagtttgttttaaaagaatccactaaatagaagagcataataataatcttgaattttgaaggacattattttcttgcatataatgacttctgtttctgaagttttgaaatctcaaggcattgttcctctcgtattttctttgttcttctgagctttgcgagcatggactggtttccacaattcctttcattcctttttttctttttgtaagatattgaaagtcaaatttcagaattattcatttctgatgtagcccttcaaattttttaatttttaaagatattgctggaagcttctacaaaagaaaaccagggcaaaagcgagttgaaatagcaatgacccagctggaattcagcaatcattttctgcttttgaagttagatcttgggcttttgctctccagaacttccctggtgcctggggagctgagttagaagttgcaattgtttaagatatatctaaataaattagaagttcaaataactgggtagccctgactgtagtggggatcaaagacagaagaactttgaaggaagcagaaaaggacgtttttaacctctatgcaccgcttcatctcctgggctttcctggtggacttcctgcctcaactctggctgaaactcagtctagacatatctaataaaagacggaaaaagaggaaagaggtgagaaagaaggaatattgaggaaagatcataatatagaagaaaagaaagaaaacatacaaccccaattctactccttatgccttcatcaggagctcctttctttccggagttggaaaaagtctctaaaaataaatttatgggtaaataattc

SEQ ID NO: 4643 - DNA, 1077 bp, Homo sapiens
  ENST00000615732
tctcccctcttcgggagcctggcgtgggtgtctcagaactgatctgctttcagtctgagttttgccatcctctgcggcgagcctgcgagcttgcacacttgggcaggatgcgctcagcgccctagctcagaggccgacccagggcagagccagtcagcgggcgctgggacgcaggactctgaacatgggtcctctgcctccctcccacctcctccaggcccggccactcggcttcctggtgaggaattcttaacgaccgccaaatccggtttctagagataaaagacggttgaagggtggctgtgctggctctggctgtggcaaatgtgactgccatggagtgaagggacaaaaggtgaggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagagtaa

SEQ ID NO: 4644 - DNA, 564 bp, Homo sapiens
  ENST00000477429
gtaggaattgagtgaagaaaaagtttgcaagtctggacagaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcgatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactt

SEQ ID NO: 4645 - DNA, 6483 bp, Homo sapiens
  ENST00000328300
agaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtcctacaggttttcaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 4646 - DNA, 6469 bp, Homo sapiens
  ENST00000361603
agaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 4647 - DNA, 782 bp, Homo sapiens
  ENST00000470339
gctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaa

SEQ ID NO: 4648 - DNA, 3622 bp, Homo sapiens
  ENST00000483338
tctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagctttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaagagaagtttctgtatgttcattccagtttaacaatgtaaagtttcttgaagtgaattttaattttctctgttatatttatattttaccagtgacattgaatatatgattttattaaaaaataatatagacatattaa

SEQ ID NO: 4649 - DNA, 537 bp, Homo sapiens
  ENST00000505728
gtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagatgataagaagatatgttttagggtttgtggccagtccaaaataaaaagggaaaactt

SEQ ID NO: 4650 - DNA, 737 bp, Homo sapiens
  ENST00000489230
aagtggtgataatttggtttatatacagatgcatggatatgaactttcagagtattcttttattgaaatgaattttaacttgaaagtatttagtgtaatgctttttagtttcttgatatttctaacagttttgatatttttcctttttgttaatgatgacattgggccttggtgaactttgatccctatccaggtcctacaggttttcaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatgg

SEQ ID NO: 4651 - DNA, 382 bp, Homo sapiens
  ENST00000510690
agtgttaacatgatgtcttcagtagagttttctattttctggattaacgaagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggtctaccaggtccagaaggtcctccaggtctccctggaaatggaggtattaaaggagagaagggaaatccaggccaacct

SEQ ID NO: 4652 - DNA, 790 bp, Homo sapiens
  ENST00000515658
aaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattattttt

SEQ ID NO: 4653 - DNA, 859 bp, Homo sapiens
  ENST00000504541
tttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaacccta

SEQ ID NO: 4654 - DNA, 8471 bp, Homo sapiens
  ENST00000371817
ggaaaaaagtgctccgcgccgaaggcgaggtccgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctggggagcccgggccacgtggtctgcttgggccgaaggggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgaccctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctatctgttttaaggtctccttgaaggcgcactggggaccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcagaaattcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacggtttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgtaaa
